US008153859B2

(12) United States Patent
Meyer et al.

(10) Patent No.: US 8,153,859 B2
(45) Date of Patent: Apr. 10, 2012

(54) DGAT GENES FROM OLEAGINOUS ORGANISMS FOR INCREASED SEED STORAGE LIPID PRODUCTION AND ALTERED FATTY ACID PROFILES IN OILSEED PLANTS

(75) Inventors: Knut Meyer, Wilmington, DE (US); Howard Glenn Damude, Hockessin, DE (US); Kevin G. Ripp, Wilmington, DE (US); Kevin L. Stecca, Bear, DE (US)

(73) Assignee: E.I. du Pont de Nemours and Company, Wilmington, DE (US)

( * ) Notice: Subject to any disclaimer, the term of this patent is extended or adjusted under 35 U.S.C. 154(b) by 271 days.

(21) Appl. No.: 12/470,517

(22) Filed: May 22, 2009

(65) Prior Publication Data

US 2009/0293151 A1    Nov. 26, 2009

Related U.S. Application Data

(60) Provisional application No. 61/055,585, filed on May 23, 2008.

(51) Int. Cl.
*A01H 1/00* (2006.01)
*A01H 5/10* (2006.01)
*A01H 15/00* (2006.01)
*C07H 21/04* (2006.01)
*C12N 5/14* (2006.01)
*C12N 1/15* (2006.01)

(52) U.S. Cl. ........ 800/278; 800/281; 800/295; 800/306; 800/312; 800/314; 800/320.1; 800/322; 536/23.1; 536/23.74; 435/320.1; 435/468; 435/471; 435/254.11

(58) Field of Classification Search ........................ None
See application file for complete search history.

(56) References Cited

U.S. PATENT DOCUMENTS

| 4,897,280 | A | * | 1/1990 | Ohtsu ............................ 426/656 |
| 6,100,077 | A | | 8/2000 | Sturley et al. |
| 6,344,548 | B1 | | 2/2002 | Farese, Jr. et al. |
| 7,015,373 | B1 | * | 3/2006 | Zou et al. ....................... 800/298 |
| 7,198,937 | B2 | * | 4/2007 | Xue et al. ...................... 435/254.2 |
| 7,202,356 | B2 | | 4/2007 | Pollak et al. |
| 2003/0115632 | A1 | | 6/2003 | Lardizabal et al. |
| 2006/0094088 | A1 | | 5/2006 | Picataggio et al. |
| 2008/0095915 | A1 | | 4/2008 | Damude et al. |

FOREIGN PATENT DOCUMENTS

| WO | 9855631 | 12/1998 |
| WO | 0001713 | 1/2000 |
| WO | 00/66749 | 11/2000 |
| WO | 2004011671 | 2/2004 |
| WO | 2005003322 | 1/2005 |
| WO | 2005049805 | 6/2005 |
| WO | 2006012325 | 2/2006 |
| WO | 2006/052914 | 5/2006 |

OTHER PUBLICATIONS

Lardizabal et al., Journal of Biological Chemistry. DGAT2 is a New Diacylglycerol Acyltransferase Gene Family: Purification, Cloning and Expression in Insect Cells of Two Polypeptides from Mortierella Ramanniana with Diacylglycerol Acyltransferase Activity, vol. 276 (42), p. 38862-38869, Jul. 31, 2001.
U.S. Appl. No. 12/470,569, filed May 22, 2009, E. I. du Pont de Nemours and Company.
U.S. Appl. No. 12/470,509, filed May 22, 2009, E. I. du Pont de Nemours and Company.
U.S. Appl. No. 12/469,026, filed May 20, 2009, E. I. du Pont de Nemours and Company.
Klein et al., Nature. High-Velocity Microprojectiles for Delivering Nucleic Acids into Living Cells, vol. 327, p. 70-73, 1987.
National Center for Biotechnology Information General Identifier No. XP_447864, Accession No. 1915382A, Jan. 23, 1994, Freire et al., Sequence of a Cytochrome C Gene from *Kluyveromyces lactis* and its Upstream Region.
National Center for Biotechnology Information General Identifier No. NP_014888, Accession No. CAA78491, Oct. 23, 2003, Ksenzenko et al., Nucleotide Sequence of the Phage T5 DNA Segment Containing Six tRNA Genes.
National Center for Biotechnology Information General Identifier No. XP_455588, Accession No. Z30130, Feb. 18, 1994, Auffray et al., Image: Molecular Integration of the Analysis of the Human Genome and its Expression.
National Center for Biotechnology Information General Identifier No. NP_983542, Accession No. R97882, Sep. 11, 1995, Hillier et al., The WashU-Merck EST Project.
National Center for Biotechnology Information General Identifier No. XP_458203, Accession No. AAA17551, May 3, 2000, Craft et al., Cone Arrestin Identified by Targeting Expression of a Functional Family.
National Center for Biotechnology Information General Identifier No. XP_001382973, Accession No. W72368, Jun. 14, 1996, Hillier et al., The WashU-Merck EST Project.
National Center for Biotechnology Information General Identifier No. XP_001527478, Accession No. AA047799, Sep. 6, 1996, Hillier et al., Generation and Analysis of 280,000 Human Expressed Sequence Tags.
National Center for Biotechnology Information General Identifier No. XP_386864, Accession No. AAA59586, Jan. 7, 1995, Richards et al., Structural and Functional Analysis of the Human Metallothionein-IA Gene: Differential Induction by Metal Ions and Glucocorticoids.
National Center for Biotechnology Information General Identifier No. XP_504700, Accession No. D20880, Jun. 21, 1994, Okubo et al., Monitoring Cell Physiology by Expression Profiles and Discovering Cell Type-Specific Genes by Compiled Expression Profiles.

(Continued)

*Primary Examiner* — Eileen B O Hara
(74) *Attorney, Agent, or Firm* — Alston & Bird LLP

(57) ABSTRACT

Transgenic soybean seed having increased total fatty acid content of at least 10% and altered fatty acid profiles when compared to the total fatty acid content of non-transgenic, null segregant soybean seed are described. DGAT genes from oleaginous organisms are used to achieve the increase in seed storage lipids.

23 Claims, 10 Drawing Sheets

OTHER PUBLICATIONS

Figure 3A:
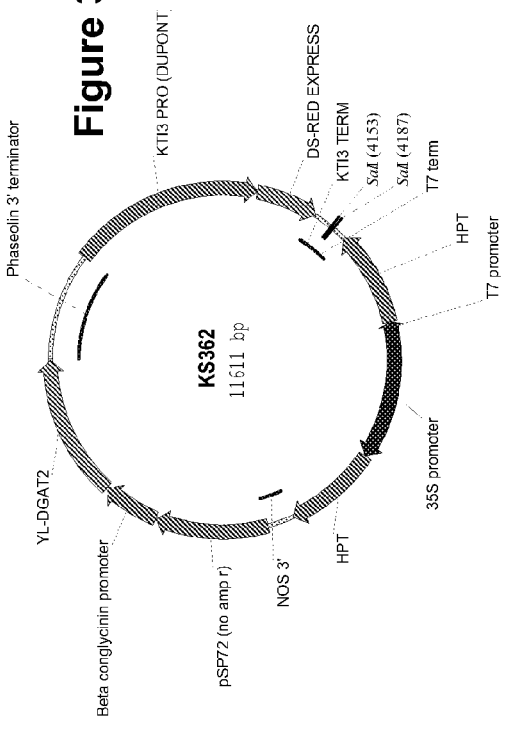

National Center for Biotechnology Information General Identifier No. XP_760084, Accession No. R08161, Apr. 5, 1995, Hillier et al., The WashU-Merck EST Project.

National Center for Biotechnology Information General Identifier No. XP_774736, Accession No. R20102, Apr. 17, 1995, Hillier et al., The WashU-Merck EST Project.

National Center for Biotechnology Information General Identifier No. XP_001247089, Accession No. A26172, Oct. 2, 1995, Fragments of Nucleic Acids Derived from an Appropriate Mycobacteria Genome, Their Applications in the Diagnosis of the Mycobacteria Infections and Plasmides Containing Said Fragments.

Bennett et al., Modification of Seed Oil Content in Soybean (Glycine max) by Expression of a Mortierella Ramanniana Diacylglycerol Acyltransferase. Internet Citation, http://abstracts.aspb.org/pb2004/public/P63/7307.html, Jul. 1, 2004.

Jako et al., Seed-Specific Over-Expression of an Arabidopsis cDNA Encoding a Diacylglycerol Acyltransferase Enhances Seed Oil Content and Seed Weight. Plant Physiology, vol. 126(2), p. 861-874, Jun. 1, 2001.

Cahoon et al., Engineering Oilseeds for Sustainable Production of Industrial and Nutritional Feedstocks: Solving Bottlenecks in Fatty Acid Flux. Current Opinion in Plant Biology, vol. 10(3), p. 236-244, Jun. 1, 2007.

Dyer et al., Engineering Plant Oils as High-Value Industrial Feedstocks for Biorefining: The Need for Underpinning Cell Biology Research. Physiologia Plantarum, vol. 132(1), p. 11-22, Jan. 2008.

Maurico et al., Influence of Oxygen on the Biosynthesis of Cellular Fatty Acids, Sterols and Phosphilipids During Alcoholic Fermentation by *Saccharomyces cerevisiae* and *Torulaspora delbrueckii*. World Journal of Microbiology and Biotechnology, vol. 14(3), p. 405-410, Jul. 1998.

Oda et al., Reexamination of Yeast Strains Classified as *Torulaspora delbrueckii*. International Journal of Systematic Bacteriology, vol. 47(4), p. 1102-1106, Oct. 1997.

PCT/US2009/044934 International Search Report, E. I. du Pont de Nemours and Company.

* cited by examiner

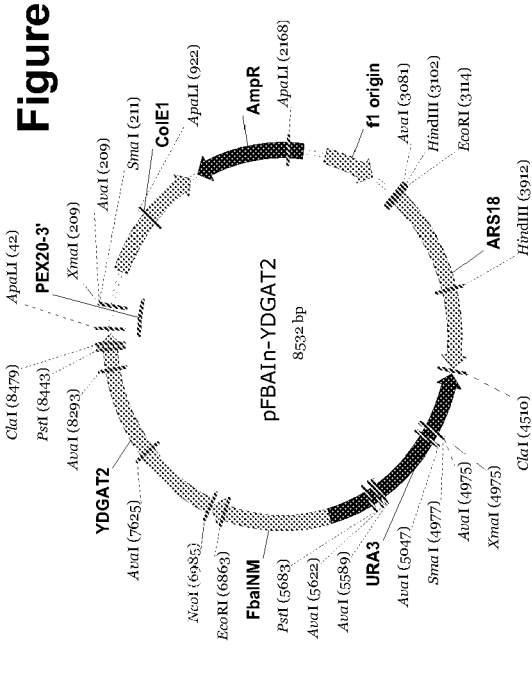
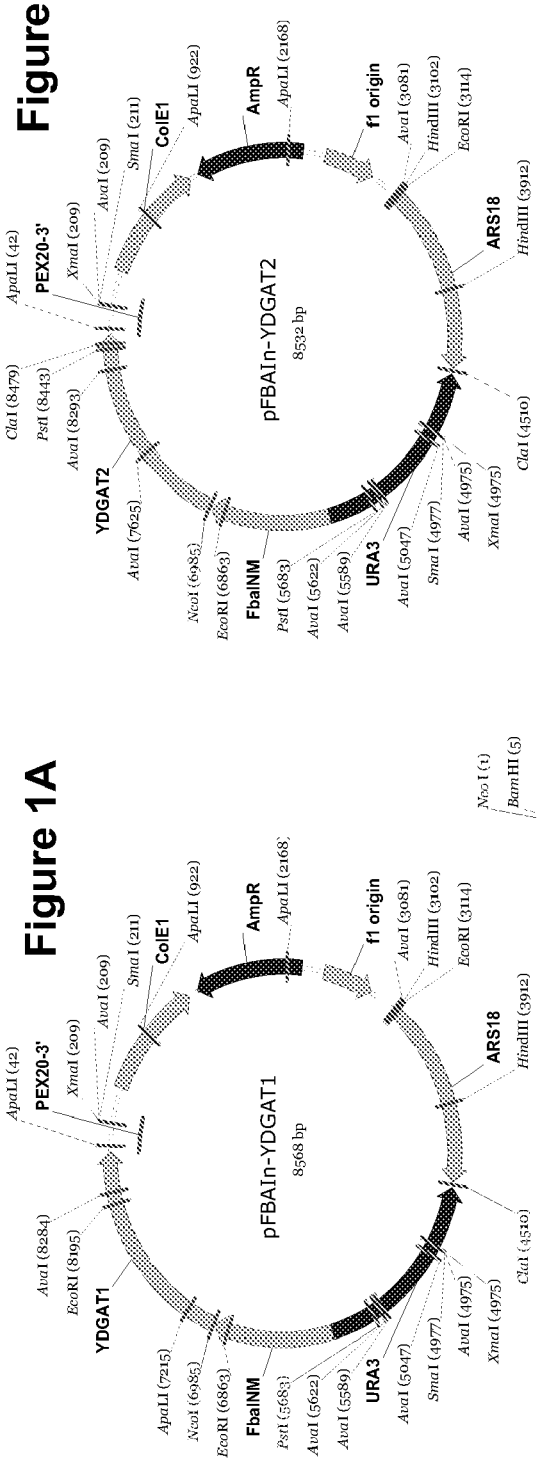
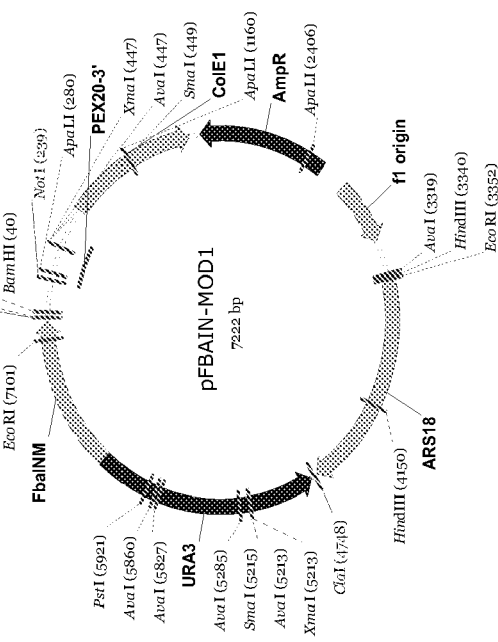

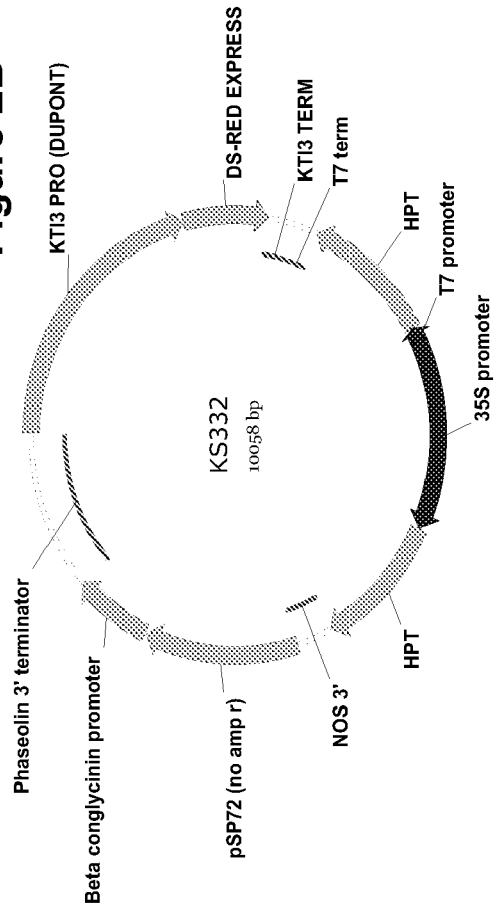

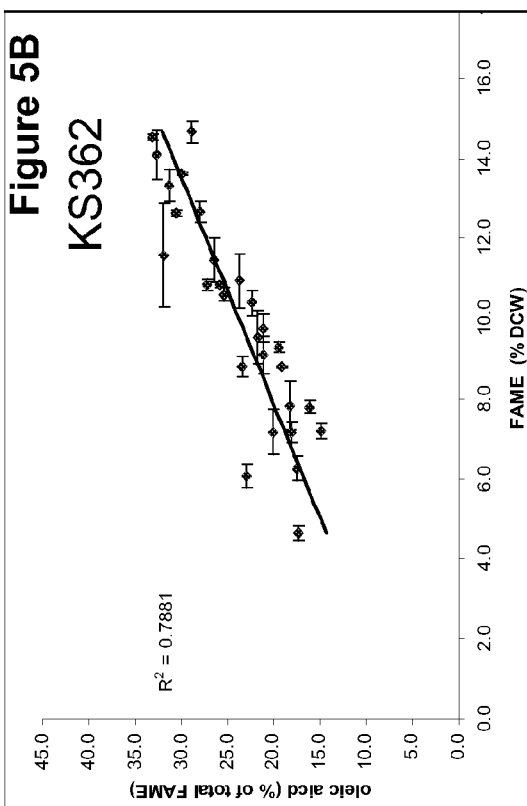
Figure 5A KS352
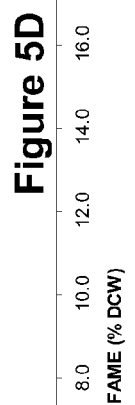
Figure 5B KS362
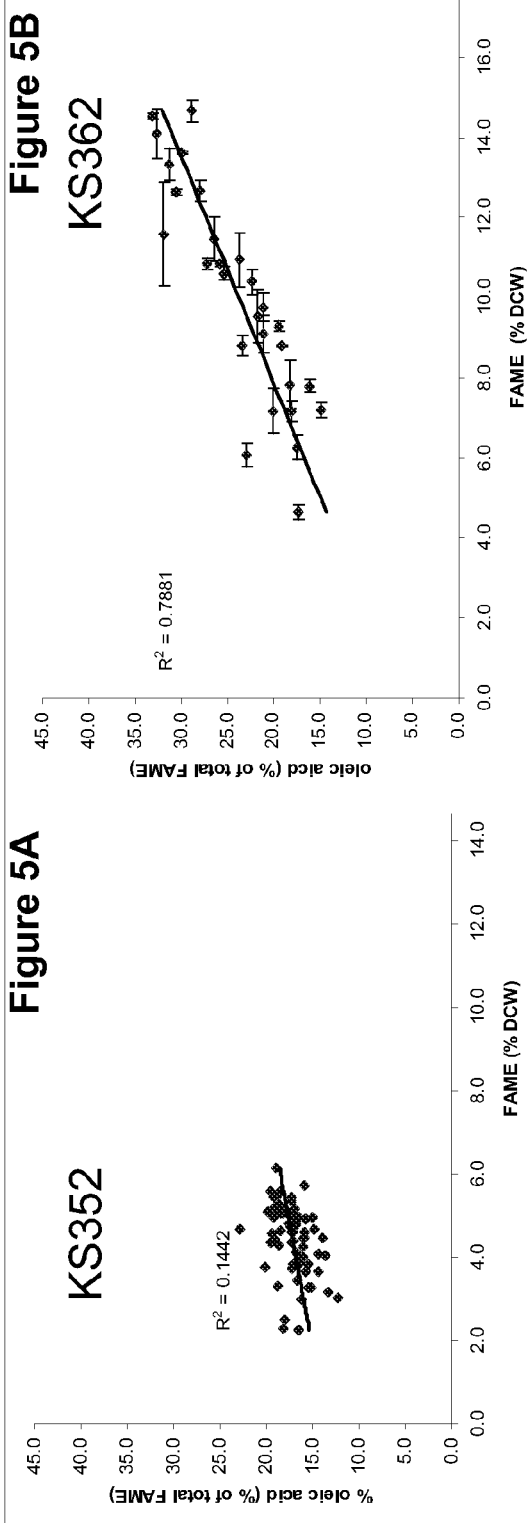
Figure 5C KS349/KS362
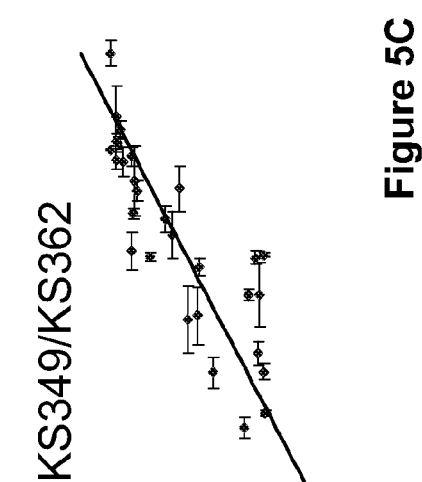
Figure 5D KS364

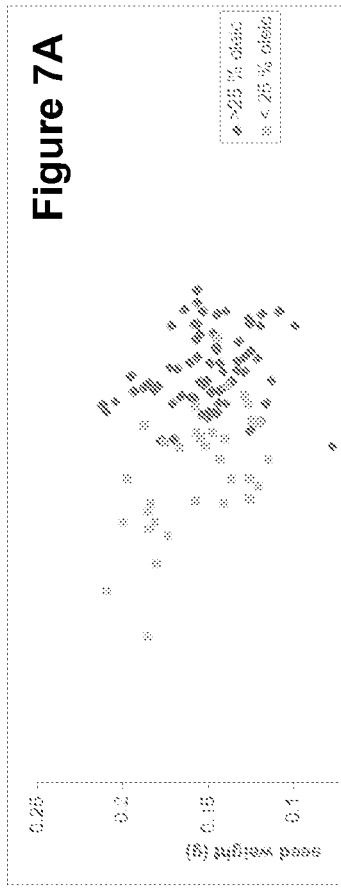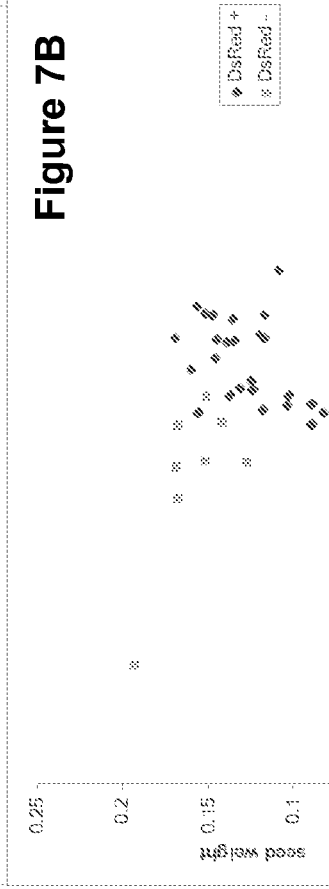

1: AFS4818.1.2
2: AFS4818.1.2
3: AFS4818.1.3
4: AFS4818.1.3
5: AFS4818.1.5
6: AFS4818.1.5
7: AFS4818.2.6
8: AFS4818.2.6
9: AFS4818.1.9
10: AFS4818.1.9
11: WT (JACK)
12: WT (JACK)

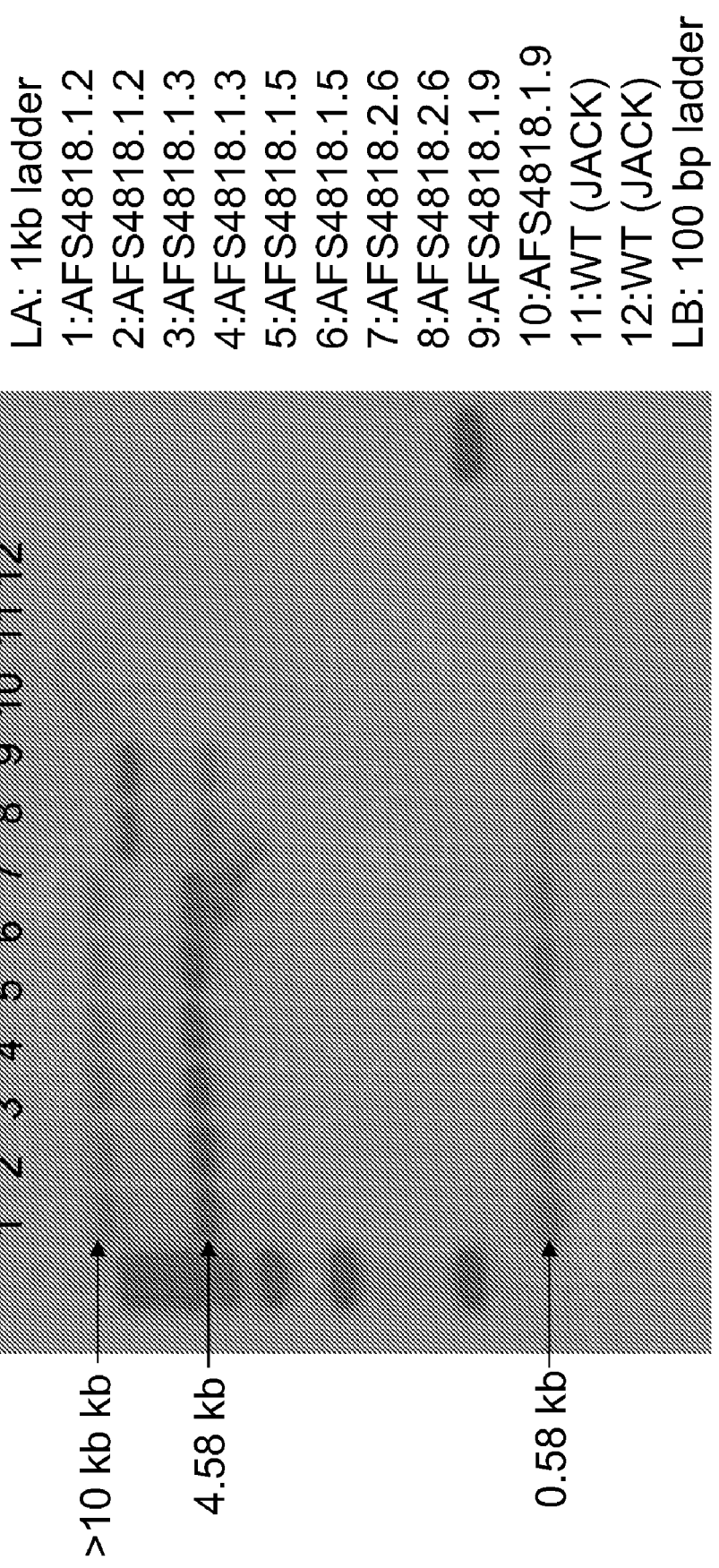

DGAT GENES FROM OLEAGINOUS ORGANISMS FOR INCREASED SEED STORAGE LIPID PRODUCTION AND ALTERED FATTY ACID PROFILES IN OILSEED PLANTS

This application claims the benefit of U.S. Provisional Application No. 61/055,585, filed May 23, 2008, the contents of which are hereby incorporated by reference.

FIELD OF THE INVENTION

This invention is in the field of biotechnology, in particular, this pertains to polynucleotide sequences encoding diacylglycerol acyltransferase genes and the use of these acyltransferases for increased seed storage lipid production and altered fatty acid profiles in oilseed plants.

BACKGROUND OF THE INVENTION

Plant lipids have a variety of industrial and nutritional uses and are central to plant membrane function and climatic adaptation. These lipids represent a vast array of chemical structures, and these structures determine the physiological and industrial properties of the lipid. Many of these structures result either directly or indirectly from metabolic processes that alter the degree of unsaturation of the lipid. Different metabolic regimes in different plants produce these altered lipids, and either domestication of exotic plant species or modification of agronomically adapted species is usually required to produce economically large amounts of the desired lipid.

There are serious limitations to using mutagenesis to alter fatty acid composition and content. Screens will rarely uncover mutations that a) result in a dominant ("gain-of-function") phenotype, b) are in genes that are essential for plant growth, and c) are in an enzyme that is not rate-limiting and that is encoded by more than one gene. In cases where desired phenotypes are available in mutant crop lines, their introgression into elite lines by traditional breeding techniques is slow and expensive, since the desired oil compositions are likely the result of several recessive genes.

Recent molecular and cellular biology techniques offer the potential for overcoming some of the limitations of the mutagenesis approach, including the need for extensive breeding. Some of the particularly useful technologies are seed-specific expression of foreign genes in transgenic plants [see Goldberg et al (1989) *Cell* 56:149-160], and the use of antisense RNA to inhibit plant target genes in a dominant and tissue-specific manner [see van der Krol et al (1988) *Gene* 72:45-50]. Other advances include the transfer of foreign genes into elite commercial varieties of commercial oilcrops, such as soybean [Chee et al (1989) *Plant Physiol.* 91:1212-1218; Christou et al (1989) *Proc. Natl. Acad. Sci. U.S.A.* 86:7500-7504; Hinchee et al (1988) *Bio/Technology* 6:915-922; EPO publication 0 301 749 A2], rapeseed [De Block et al (1989) *Plant Physiol.* 91:694-701], and sunflower [Everett et al (1987) *Bio/Technology* 5:1201-1204], and the use of genes as restriction fragment length polymorphism (RFLP) markers in a breeding program, which makes introgression of recessive traits into elite lines rapid and less expensive [Tanksley et al (1989) *Bio/Technology* 7:257-264]. However, application of each of these technologies requires identification and isolation of commercially-important genes.

Most free fatty acids become esterified to coenzyme A (CoA), to yield acyl-CoAs. These molecules are then substrates for glycerolipid synthesis in the endoplasmic reticulum of the cell, where phosphatidic acid and diacylglycerol (DAG) are produced. Either of these metabolic intermediates may be directed to membrane phospholipids (e.g., phosphatidylglycerol, phosphatidylethanolamine, phosphatidylcholine) or DAG may be directed to form triacylglycerols (TAGs), the primary storage reserve of lipids in eukaryotic cells.

Diacylglycerol acyltransferase ("DGAT") is an integral membrane protein that catalyzes the final enzymatic step in the production of triacylglycerols in plants, fungi and mammals. This enzyme is responsible for transferring an acyl group from acyl-coenzyme-A to the sn-3 position of 1,2-diacylglycerol ("DAG") to form triacylglycerol ("TAG"). DGAT is associated with membrane and lipid body fractions in plants and fungi, particularly, in oilseeds where it contributes to the storage of carbon used as energy reserves. TAG is believed to be an important chemical for storage of energy in cells. DGAT is known to regulate TAG structure an direct TAG synthesis. Furthermore, it is known that the DGAT reaction is specific for oil synthesis.

TAG is the primary component of vegetable oil in plants, it is used by the seed as a stored form of energy to be used during seed germination.

Two different families of DGAT proteins have been identified. The first family of DGAT proteins ("DGAT1") is related to the acyl-coenzyme A:cholesterol acyltransferase ("ACAT") and has been described in U.S. Pat. Nos. 6,100,077 and 6,344,548. A second family of DGAT proteins ("DGAT2") is unrelated to the DGAT1 family and is described in PCT Patent Publication WO 2004/011671 published Feb. 5, 2004. Other references to DGAT genes and their use in plants include PCT Publication Nos.WO2004/011,671, WO1998/055,631, and WO2000/001,713, and US Patent Publication No. 20030115632.

Applicants' Assignee's copending published patent application US 2006-0094088 describes genes for DGATs of plants and fungi and their use is in modifying levels of polyunsaturated fatty acids ("PUFAs") in edible oils.

Applicants' Assignee's published PCT application WO 2005/003322 describes the cloning of phosphatidylcholine diacylglycerol acyltransferase and DGAT2 for altering PUFA and oil content in oleaginous yeast.

SUMMARY OF THE INVENTION

The present invention concerns a transgenic soybean seed having increased total fatty acid content of at least 10% when compared to the total fatty acid content of a non-transgenic, null segregant soybean seed.

In a second embodiment, the present invention concerns a method for increasing the total fatty acid content of a soybean seed comprising:

(a) transforming at least one soybean cell with a recombinant construct having at least one DGAT sequence;

(b) selecting the transformed soybean cell(s) of step (a) having an increased total fatty acid content of at least 10% when compared to the total fatty acid content of a non-transgenic, null segregant soybean seed.

In a third embodiment, the present invention concerns a transgenic corn kernel having increased total fatty acid content of at least 10% when compared to the total fatty acid content of a non-transgenic, null segregant corn kernel.

In a fourth embodiment, the present invention concerns a method for increasing the total fatty acid content of a corn kernel comprising:

(a) transforming at least one corn kernel with a recombinant construct having at least one DGAT sequence;

(b) selecting the transformed corn kernel(s) of step (a) having an increased total fatty acid content of at least 10% when compared to the total fatty acid content of a non-transgenic, null segregant corn kernel.

In a fifth embodiment, the present invention concerns a transgenic soybean seed having increased total fatty acid content of at least 10% and an increased oleic acid content of at least 25% when compared to the total fatty acid content and oleic acid content of a non-transgenic, null segregant soybean seed.

In a further embodiment, the present invention concerns a transgenic soybean having increased total fatty acid content of at least 10% and at least any one of i) an increased oleic acid content of at least 25%; ii) a decreased linolenic acid content of at least 25%; iii) a decreased linoleic acid content of at least 4%; iv) a decreased palmitic acid content of at least 8%; and v) an increased stearic acid content of at lease 14% when compared to the total fatty acid content and oleic, linolenic acid, linoelic acid, palmitic acid or stearic acid, respectively, content of a non-transgenic, null segregant soybean seed.

In an sixth embodiment, the present invention concerns a method for increasing the total fatty acid content and oleic acid content of a soybean seed comprising:

(a) transforming at least one soybean cell with a recombinant construct having at least one DGAT sequence;

(b) selecting the transformed soybean cell(s) of step (a) having an increased total fatty acid content of at least 10% and an increased oleic acid content of at least 25% when compared to the total fatty acid content and oleic acid content of a non-transgenic, null segregant soybean seed.

In a seventh embodiment, the present invention concerns a method for increasing the total fatty acid content and decreasing linolenic acid content of a soybean seed comprising:

(a) transforming at least one soybean cell with a recombinant construct having at least one DGAT sequence;

(b) selecting the transformed soybean cell(s) of step (a) having an increased total fatty acid content of at least 10% and a decreased linolenic acid content of at least 25% when compared to the total fatty acid content and oleic acid content of a non-transgenic, null segregant soybean seed.

In an eighth embodiment, the present invention concerns a method for increasing the total fatty acid content and decreasing linoleic acid content of a soybean seed comprising:

(a) transforming at least one soybean cell with a recombinant construct having at least one DGAT sequence;

(b) selecting the transformed soybean cell(s) of step (a) having an increased total fatty acid content of at least 10% and a decreased linoleic acid content of at least 4% when compared to the total fatty acid content and oleic acid content of a non-transgenic, null segregant soybean seed.

In a ninth embodiment, the present invention concerns a method for increasing the total fatty acid content and decreased palmitic acid content of a soybean seed comprising:

(a) transforming at least one soybean cell with a recombinant construct having at least one DGAT sequence;

(b) selecting the transformed soybean cell(s) of step (a) having an increased total fatty acid content of at least 10% and a decreased palmitic acid content of at least 8% when compared to the total fatty acid content and oleic acid content of a non-transgenic, null segregant soybean seed.

In a tenth embodiment, the present invention concerns a method for increasing the total fatty acid content and stearic acid content of a soybean seed comprising:

(a) transforming at least one soybean cell with a recombinant construct having at least one DGAT sequence;

(b) selecting the transformed soybean cell(s) of step (a) having an increased total fatty acid content of at least 10% and an increased stearic acid content of at least 14% when compared to the total fatty acid content and oleic acid content of a non-transgenic, null segregant soybean seed.

Any of the transgenic seed of the invention may comprise a recombinant construct having at least one DGAT sequence which can be selected from the group consisting of DGAT1, DGAT2 and DGAT1 in combination with DGAT2. Furthermore, the DGAT sequence can be an oleaginous organism sequence.

Also within the scope of the invention are product(s) and/or by-product(s) obtained from the transgenic soybean seeds of the invention.

In a tenth embodiment the present invention concerns an isolated polynucleotide comprising:

(a) a nucleotide sequence encoding a polypeptide having diacylglycerol acyltransferase activity wherein the polypeptide has at least 80% amino acid identity, based on the Clustal V method of alignment, when compared to an amino acid sequence as set forth in SEQ ID NOs: 135, 136, 147, 162, 176, 215, 234, 265, 272, 299, 304, 306, 308, 310, 312, 314, 316, 318, 320, 322, 351, or 363;

(b) a nucleotide sequence encoding a polypeptide having diacylglycerol acyltransferase activity, wherein the nucleotide sequence has at least 80% sequence identity, based on the BLASTN method of alignment, when compared to a nucleotide sequence as set forth in SEQ ID NO: 133, 134, 146, 161, 175, 214, 233, 264, 271, 298, 303, 305, 307, 309, 311, 313, 315, 317, 319, 321, 350, or 362:

(c) a nucleotide sequence encoding a polypeptide having diacylglycerol acyltransferase activity, wherein the nucleotide sequence hybridizes under stringent conditions to a nucleotide sequence as set forth in SEQ ID NO: 133, 134, 146, 161, 175, 214, 233, 264, 271, 298, 303, 305, 307, 309, 311, 313, 315, 317, 319, 321, 350, or 362; or (d) a complement of the nucleotide sequence of (a), (b) or (c), wherein the complement and the nucleotide sequence consist of the same number of nucleotides and are 100% complementary.

It can also be appreciated that the present invention concerns an isolated polynucleotide comprising:

(a) a nucleotide sequence encoding a polypeptide having diacylglycerol acyltransferase activity wherein the polypeptide is set forth in SEQ ID NOs:135, 136, 147, 162, 176, 215, 234, 265, 272, 299, 304, 306, 308, 310, 312, 314, 316, 318, 320, 322, 351, or 363;

(b) a nucleotide sequence encoding a polypeptide having diacylglycerol acyltransferase activity, wherein the nucleotide sequence is set forth in SEQ ID NO: 133, 134, 146, 161, 175, 214, 233, 264, 271, 298, 303, 305, 307, 309, 311, 313, 315, 317, 319, 321, 350, or 362; or (c) a complement of the nucleotide sequence of (a) or (b) wherein the complement and the nucleotide sequence consist of the same number of nucleotides and are 100% complementary.

The isolated polynucleotide encoding diacylglycerol acyltransferase may be obtained from one or more oleaginous organism. These oleaginous organisms can be, but are not limited to, *Torulaspora delbrueckii, Pichia anomala, Debaryomyces hansenii, Candida zeylanoides, Lipomyces starkeyi, Mucor circinelloides, Phaffia rhodozyma, Rhodotorula glutinis, Cryptococcus curvatus,* and *Mortierella alpina.*

Recombinant DNA construct comprising the isolated nucleic acid fragment encoding diacylglycerol acyltransferase can be operably linked to at least one regulatory sequence, and can be incorporated into a cell. The cell may be from an oilseed plant.

In an eleventh embodiment the present invention concerns a method for increasing the total fatty acid content of an oilseed comprising:

(a) transforming at least one oilseed cell with the above mentioned recombinant construct;

(b) selecting the transformed oilseed cell(s) of step (a) having an increased total fatty acid content when compared to the total fatty acid content of a non-transgenic, null segregant oilseed.

In a twelfth embodiment the present invention concerns seed products and by-products and progeny obtained from the oilseeds transformed with the above mentioned recombinant constructs.

In a final embodiment the present invention concerns fungi, or microbial oleaginous organisms, comprising a recombinant DNA construct comprising any isolated nucleic acid fragments encoding any diacylglycerol acyltransferase of the present invention. Further, the fungal cell can be, but is not limited to, *Yarrowia, Candida, Rhodotorula, Rhodosporidium, Cryptococcus, Trichosporon* and *Lipomyces*.

BRIEF DESCRIPTION OF THE DRAWINGS AND SEQUENCE LISTINGS

The invention can be more fully understood from the following detailed description and the accompanying drawings and Sequence Listing, which form a part of this application.

FIG. 1 provides plasmid maps for pFBAIn-YLDGAT1, for pFBAIn-YLDGAT2, and for pFBAIn-MOD1.

FIG. 2 provides plasmid maps for KS352 and KS332.

Figure 3B:
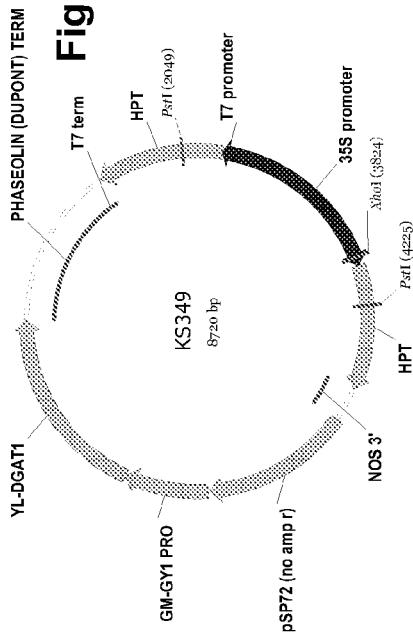
Figure 3C:
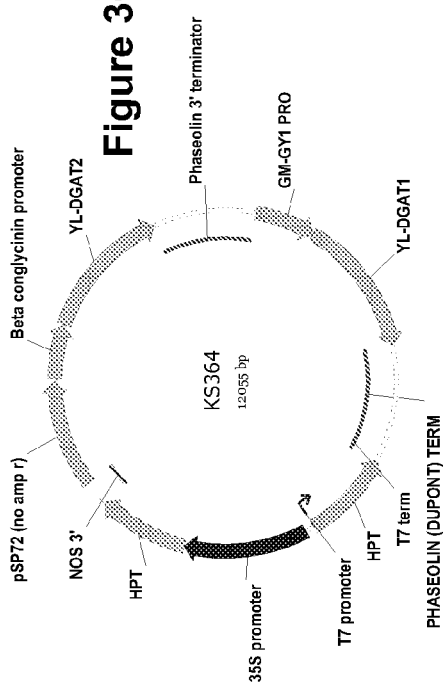

FIG. 3 provides plasmid maps for KS349, KS362, and KS364.

Figures 4A, 4B:
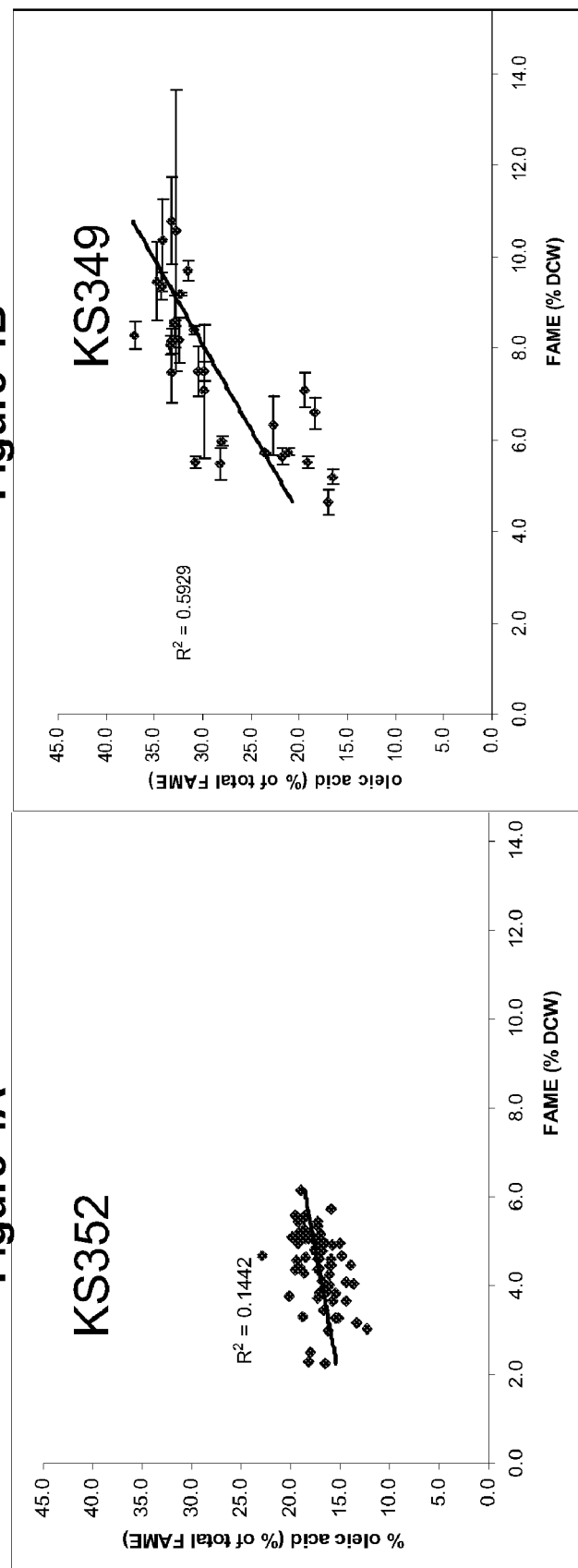

FIG. 4 provides a strong correlation ($R^2 \geq 0.59$) between the oleic acid content and the total esterified fatty acid content for somatic embryos generated with KS349.

FIG. 5 provides a strong correlation ($R^2 \geq 0.67$) between the oleic acid content and the total esterified fatty acid content for somatic embryos generated with KS362 alone or in combination with KS349 as well as with KS364.

Figure 6A:
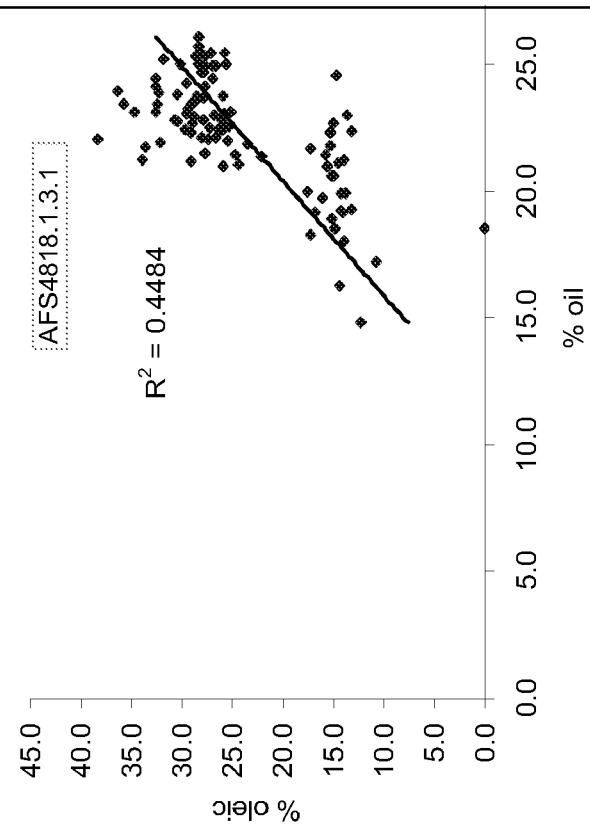
Figure 6B:
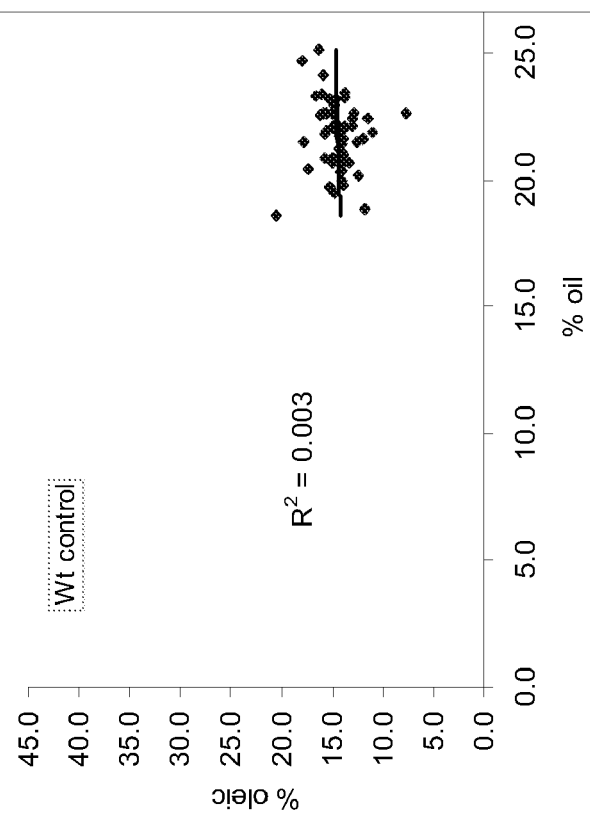

FIG. 6 provides a correlation ($R^2 \geq 0.45$) between the oleic acid content and the oil content for transgenic soy seed (T1 generation) generated by co-transformation of plasmids KS349 and KS362.

FIG. 7 provides oil content and seed weight of T1 seed generated by co-transformation of plasmids KS349 and KS362 (A) and KS362 alone (B).

FIG. 8 provides hybridization results from genomic DNA blots. Genomic DNA was isolated from transgenic soybeans obtained from events AFS4818.1.2, AFS4818.1.3, AFS4818.1.5, AFS48182.6, AFS4818.1.9 (See Example 6). DNA was digested with EcoRI or HindIII and run out on a gel and blotted to nylon filters [AFS4818.1.2 lanes 1and 2, AFS4818.1.3 lanes 3 and 4, AFS4818.1.5 lanes 5 and 6, AFS48182.6 lanes 7 and 8, AFS4818.1.9 lanes 9 and 10, and lanes 11 and 12 are non-transgenic wild-type DNA also digested with EcoRI and HindIII]. Hybridization probes were a *Yarrowia* DGAT1-specific probe for the upper blot (A) and the lower blot was probed with a *Yarrowia* DGAT2 specific probe.

FIG. 9 provides hybridization results from genomic DNA blots. The blots are similar to those described in FIG. 8 except the DNAs were all digested with BstXI and the blot was probed with a *Yarrowia* DGAT2 specific probe.

Figure 10:
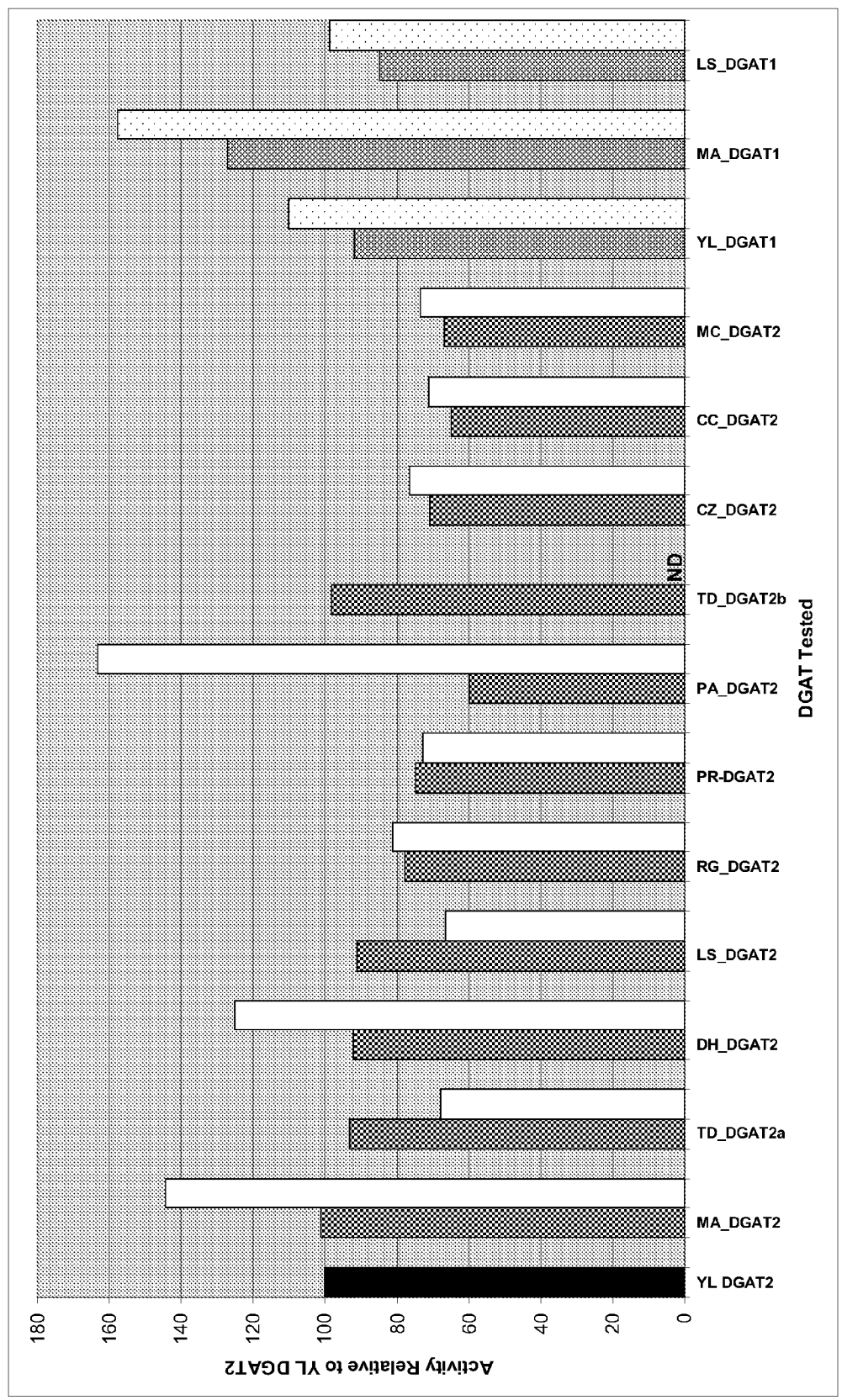

FIG. 10 *Yarowia lipolytica* (YL) wild-type DGAT2 activity (black bar) is a normalized activity set to 100%. *Mortierella alpine* (MA), *Torulaspora delbrueckii* (TD), *Debaryomyces hansenii* (DH), *Lipomyces starkeyi* (LS), *Rhodottorula glutinis* (RG), *Phaffia rhodozyma* (PR), *Pichia anomala* (PA), *Candida zeylanoides* (CZ), *Cryptococcus curvatus* (CC), and *Murcor circinelloides* (MC) DGAT2 constructs were wild-type (checkered bars) or codon optimized/motif altered (white bars). The results are the average of oil levels of the top five events from each construct which are then then normalized to the average of the top five events for YL DGAT2 tested in the same experimental set. YL, MS, and LS DGAT1 constructs are shown in the last three sets. The TD DGAT2b codon optimized/motif-altered version was not tested (ND). Details of the constructs and the assay results can be found in the Examples.

The sequence descriptions summarize the Sequences Listing attached hereto. The Sequence Listing contains one letter codes for nucleotide sequence characters and the single and three letter codes for amino acids as defined in the IUPAC-IUB standards described in *Nucleic Acids Research* 13:3021-3030 (1985) and in the *Biochemical Journal* 219(2):345-373 (1984).

| Summary Of Nucleic Acid And Protein SEQ ID Numbers | | |
|---|---|---|
| Description and Abbreviation | Nucleic acid SEQ ID NO. (bp) | Protein SEQ ID NO. (aa) |
| *Yarrowia lipolytica* DGAT1 gene | 1 (1581 bp) | |
| Plasmid pYDA1 | 2 (8325 bp) | |
| Plasmid py75 | 3 (7518 bp) | |
| Plasmid pY75 YLDGAT1: YLDGAT1 inserted into pY75 | 4 (9109) | |
| Plasmid pRS425 | 5 (6849 bp) | |
| Plasmid pGDP425 | 6 (7494 bp) | |
| *Yarrowia lipolytica* DGAT2 gene | 9 (1545 bp) | 10 (514 aa) |
| Plasmid pY75 YLDGAT2, pY75 with YL DGAT2 inserted | 11 (9070 bp) | |
| *Yarrowia lipolytica* DGAT1 gene variant with NcoI and NotI sites added | 16 (1603 bp) | |
| *Yarrowia lipolytica* DGAT2 gene variant with NcoI and NotI sites added | 17 (1567 bp) | |
| Plasmid pFBAIN-MOD-1 | 18 (6991 bp) | |
| Plasmid pFBAIN-YLDGAT, pFBAIN with YL DGAT1 inserted | 19 (8568 bp) | |
| Plasmid pFBAIN-YLDGAT2 | 20 (8532 bp) | |
| Plasmid pKS123 | 21 (7049 bp) | |
| cal a24-4 | 22 (1098 bp) | |
| Plasmid pKR53B | 25 (8138 bp) | |
| Plasmid pKR72 | 26 (7085 bp) | |
| Plasmid pKR85 | 27 (7085 bp) | |
| Plasmid pPCR85 | 30 (4827 bp) | |
| Plasmid pKR91 | 31 (15114 bp) | |
| Plasmid pKR92 | 32 (13268 bp) | |

Summary Of Nucleic Acid And Protein SEQ ID Numbers

| Description and Abbreviation | Nucleic acid SEQ ID NO. (bp) | Protein SEQ ID NO. (aa) |
|---|---|---|
| Plasmid pKR92 YL DGAT2, pKR92 with the YL DGAT2 gene inserted | 33 (19604 bp) | |
| Plasmid pKR92 YL DGAT1 YL DGAT2 | 34 (20082 bp) | |
| Soybean glycinin 1 (GY1) gene (Genbank X15121) | 35 (3527 bp) | |
| Soybean GY1 promoter | 36 (690 bp) | |
| Plasmid pZBL114 | 39 (6660 bp) | |
| Soybean GM GY1 (glycinin 1) gene | 40 (1437 bp) | |
| Synthetic BHL8 (barley high lysine) gene | 41 (204 bp) | |
| GY1-BHL8 fusion product | 42 (1701 bp) | |
| Plasmid pZBL133 | 43 (6493 bp) | |
| Plasmid pKS238 | 44 (6472 bp) | |
| Plasmid pKS240 | 45 (6259 bp) | |
| Plasmid pKS120 | 46 (5267 bp) | |
| Plasmid pKS242 | 47 (8643 bp) | |
| Plasmid pKS349 | 48 (8720 bp) | |
| Plasmid pKS121/BS | 49 (5280 bp) | |
| Plasmid pDs-Red in pKS121/BS | 50 (5968 bp) | |
| Plasmid pKS332 | 51 (10058 bp) | |
| Plasmid pKS362 | 52 (11611 bp) | |
| Soybean promoter GM P34 | 53 (1422 bp) | |
| Plasmid pZBL115 | 56 (7466 bp) | |
| Plasmid pJS89 | 57 (7841 bp) | |
| Morteriella alpina delta-6 desaturase gene coding sequence | 58 (1390 bp) | |
| Plasmid pJS93 | 59 (9223 bp) | |
| Plasmid pKS127 | 60 (7472 bp) | |
| Plasmid pKS343 | 61 (7847 bp) | |
| Plasmid pKS352 | 62 (10866 bp) | |
| Plasmid pKS364 | 63 (12055 bp) | |
| Yarrowia lipolytica DGAT1 gene codon optimized for soybean | 64 (1581 bp) | 65 (526 aa) |
| Yarrowia lipolytica DGAT2 gene codon optimized for soybean | 66 (1545 bp) | 67 (514 aa) |
| Plasmid pKR1234 | 68 (8638 bp) | |
| Plasmid ppPSgly32 | 71 (3673 bp) | |
| Plasmid pKR264 | 72 (4171 bp) | |
| Plasmid pKR1212 | 73 (6130 bp) | |
| Plasmid pKR1235 | 74 (5764 bp) | |
| Plasmid pKR1236 comprising both Yarrowia lipolytica DGAT1 and DGAT2 | 75 (11693 bp) | |
| Plasmid pKR1254 comprising wild-type Yarrowia lipolytica DGAT2 | 78 (5079 bp) | |
| Plasmid pKR1254_Y326F, pKR1254 comprising mutant Y326F Yarrowia lipolytica DGAT2 | 81 (5079 bp) | |
| Yarrowia lipolytica DGAT2 comprising codon 326 mutated from Tyr to Phe | 82 (1545 bp) | 83 (514 aa) |
| Plasmid pKR1254_Y326L, pKR1254 comprising mutant Y326L Yarrowia lipolytica DGAT2 | 86 (5079 bp) | |
| Yarrowia lipolytica DGAT2 comprising codon 326 mutated from Tyr to Leu | 87 (1545 bp) | 88 (514 aa) |
| Plasmid pKR1254_R327K, pKR1254 comprising mutant R327K Yarrowia lipolytica DGAT2 | 91 (5079 bp) | |
| Yarrowia lipolytica DGAT2 comprising codon 327 mutated from Arg to Lys | 92 (1545 bp) | 93 (514 aa) |
| Plasmid pY191 yeast expression vector comprising wild-type Yarrowia lipolytica DGAT2 | 94 (9074 bp) | |
| Plasmid pY192 yeast expression vector comprising mutant Y326F Yarrowia lipolytica DGAT2 | 95 (9074 bp) | |
| Plasmid pY193 yeast expression vector comprising mutant Y326L Yarrowia lipolytica DGAT2 | 96 (9074 bp) | |
| Plasmid pY194 yeast expression vector comprising mutant R327K Yarrowia lipolytica DGAT2 | 97 (9074 bp) | |
| Plasmid pKR1256 soybean expression vector comprising wild-type Yarrowia lipolytica DGAT2 | 98 (8641 bp) | |
| Plasmid pKR1277 soybean expression vector comprising mutant Y326F Yarrowia lipolytica DGAT2 | 99 (8641 bp) | |
| Plasmid pKR1278 soybean expression vector comprising mutant Y326L Yarrowia lipolytica DGAT2 | 100 (8641 bp) | |
| Plasmid pKS392 comprising Yarrowia lipolytica DGAT1 codon optimized for soybean driven by b-conglycinin promoter | 101 (11647 bp) | |
| Plasmid pKS393 comprising Yarrowia lipolytica DGAT2 codon optimized for soybean driven by b-con promoter | 102 (11611 bp) | |
| Plasmid pKS391 comprising wild-type Yarrowia lipolytica DGAT1 driven by b-con promoter | 103 (11649 bp) | |
| Consensus sequence from 5 independently isolated cosmids for Td (Torulaspora delbrueckii) DGAT2A | 131 (2567 bp) | |
| Consensus sequence from 5 independently isolated cosmids for Td (Torulaspora delbrueckii) DGAT2B | 132 (2700 bp) | |
| Genomic sequence for Td (Torulaspora delbrueckii) DGAT2A | 133 (1362 bp) | 135 (453 aa) |
| Genomic sequence for Td (Torulaspora delbrueckii) DGAT2B | 134 (1362 bp) | 136 (453 aa) |
| Consensus sequence from 5 independently isolated cosmids for Pa (Pichia anomala) DGAT2 | 145 (2062 bp) | |
| Genomic sequence for Pa (Pichia anomala) DGAT2 | 146 (1290 bp) | 147 (429 aa) |
| Consensus sequence from 3 independently isolated cosmids for Dh (Debaryomyces hansenii) DGAT2 | 160 (2800 bp) | |
| Genomic sequence for Dh (Debaryomyces hansenii) DGAT2 | 161 (2028 bp) | 162 (675 aa) |
| Consensus sequence from 4 independently isolated cosmids for Cz (Candida zeylanoides) DGAT2 | 174 (3021 bp) | |
| Genomic sequence for Cz (Candida zeylanoides) DGAT2 | 175 (1695 bp) | 176 (564 aa) |
| Consensus sequence from 2 independently isolated cosmids for Ls (Lipomyces starkeyi) DGAT1 | 189 (3343 bp) | |

Summary Of Nucleic Acid And Protein SEQ ID Numbers

| Description and Abbreviation | Nucleic acid SEQ ID NO. (bp) | Protein SEQ ID NO. (aa) |
|---|---|---|
| Genomic sequence for Ls (*Lipomyces starkeyi*) DGAT2 | 194 (2090 bp) | |
| Genomic sequence from 7 independently isolated cosmids for Rg (*Rhodotorula glutinis*) DGAT2 | 204 (2944 bp) | |
| PCR/RACE assembled DGAT2 from Pr (*Phaffia rhodozyma*) | 214 (1218 bp) | 215 (405 aa) |
| Consensus sequence from 7 independently isolated cosmids for Cc (*Cryptococcus curvatus*) | 226 (2816 bp) | |
| PCR/RACE assembled DGAT2 from Mc (*Mucor circinelloides*) | 233 (1110 bp) | 234 (369 aa) |
| Plasmid pKR1295 comprising the *Torulaspora delbrueckii* DGAT2a | 237 (4895 bp) | |
| Plasmid pKR1324 comprising the *Torulaspora delbrueckii* DGAT2a | 238 (8457 bp) | |
| Plasmid pKR1296 comprising the *Torulaspora delbrueckii* DGAT2b | 241 (4896 bp) | |
| Plasmid pKR1325 comprising the *Torulaspora delbrueckii* DGAT2b | 242 (8458 bp) | |
| Plasmid pKR1297 comprising *Debaryomyces hansenii* DGAT2 | 245 (5561 bp) | |
| Plasmid pKR179 comprising *Debaryomyces hansenii* DGAT2 | 246 (4480 bp) | |
| Plasmid pKR1327 comprising *Debaryomyces hansenii* DGAT2 | 247 (6519 bp) | |
| Plasmid pKR325 comprising *Debaryomyces hansenii* DGAT2 | 248 (5303 bp) | |
| Plasmid pKR1328 comprising *Debaryomyces hansenii* DGAT2 | 249 (9122 bp) | |
| Plasmid pMDGAT2-17 comprising *Mortierella alpina* DGAT2 | 250 (8084 bp) | |
| Plasmid pKR1330 comprising *Mortierella alpina* DGAT2 | 253 (4529 bp) | |
| *Mortierella alpina* DGAT2 | 254 (996 bp) | 255 (331 aa) |
| Plasmid pKR1335 comprising *Mortierella alpina* DGAT2 | 256 (8091 bp) | |
| Plasmid pKR1319 comprising *Pichia anomala* DGAT2 | 259 (4824 bp) | |
| Plasmid pKR1332 comprising *Pichia anomala* DGAT2 | 260 (8386 bp) | |
| Plasmid pHD28 comprising *Rhodotorula glutinis* DGAT2 | 263 (4573 bp) | |
| *Rhodotorula glutinis* DGAT2 | 264 (1041 bp) | 265 (346 aa) |
| Plasmid pKR1333 comprising *Rhodotorula glutinis* DGAT2 | 266 (8137 bp) | |
| Plasmid pHD30 comprising *Lipomyces starkeyi* DGAT2 | 270 (4766 bp) | |
| *Lipomyces starkeyi* DGAT2 | 271 (1233 bp) | 272 (410 aa) |
| Plasmid pKR1337 comprising *Lipomyces starkeyi* DGAT2 | 273 (8329 bp) | |
| Plasmid pMDGAT1-17 comprising *Mortierella alpina* DGAT1 | 274 (8666 bp) | |
| Plasmid pKR1329 comprising *Mortierella alpina* DGAT1 | 277 (5111 bp) | |
| *Mortierella alpina* DGAT1 | 278 (1578 bp) | 279 (525 aa) |
| Plasmid pKR1334 comprising *Mortierella alpina* DGAT1 | 280 (8674 bp) | |
| Plasmid pKR1314 comprising *Yarrowia lipolytica* DGAT1 | 281 (4547 bp) | |
| Plasmid pKR1310 comprising part of the codon optimized *Yarrowia lipolytica* DGAT1 | 286 (4749 bp) | |
| Plasmid pKR1316 comprising codon optimized *Yarrowia lipolytica* DGAT1 | 287 (5136 bp) | |
| Codon optimized *Yarrowia lipolytica* DGAT1 | 288 (1581 bp) | |
| Plasmid pKR1323 comprising codon optimized *Yarrowia lipolytica* DGAT1 | 289 (8677 bp) | |
| Plasmid pHD37 comprising *Phaffia rhodozyma* DGAT2 | 292 (4751 bp) | |
| *Phaffia rhodozyma* DGAT2 | 293 (1218 bp) | |
| Plasmid pKR1372 comprising *Phaffia rhodozyma* DGAT2 | 294 (8314 bp) | |
| Plasmid pHD38 comprising *Lipomyces starkeyi* DGAT1 | 297 (5198 bp) | |
| *Lipomyces starkeyi* DGAT1 | 298 (1665 bp) | 299 (554 aa) |
| Plasmid pKR1375 comprising *Lipomyces starkeyi* DGAT1 | 300 (8761 bp) | |
| Codon optimized *Mortierella alpina* DGAT1 | 301 (1578 bp) | |
| Codon optimized *Lipomyces starkeyi* DGAT1 | 302 (1665 bp) | |
| Codon optimized and Tyr to Phe mutated *Torulaspora delbrueckii* DGAT2A | 303 (1362 bp) | 304 (453 aa) |
| Codon optimized and Tyr to Phe mutated *Torulaspora delbrueckii* DGAT2B | 305 (1362 bp) | 306 (453 aa) |
| Codon optimized and Tyr to Phe mutated *Pichia anomala* DGAT2 | 307 (1290 bp) | 308 (429 aa) |
| Codon optimized and Tyr to Phe mutated *Debaryomyces hansenii* DGAT2 | 309 (2028 bp) | 310 (675 aa) |
| Codon optimized and Tyr to Phe mutated *Candida zeylanoides* DGAT2 | 311 (1695 bp) | 312 (564 aa) |
| Codon optimized and Tyr to Phe mutated *Lipomyces starkeyi* DGAT2 | 313 (1233 bp) | 314 (410 aa) |
| Codon optimized and Tyr to Phe mutated *Mucor circinelloides* DGAT2 | 315 (1110 bp) | 316 (369 aa) |
| Codon optimized and Tyr to Phe mutated *Phaffia rhodozyma* DGAT2 | 317 (1218 bp) | 318 (405 aa) |
| Codon optimized and Tyr to Phe mutated *Rhodotorula glutinis* DGAT2 | 319 (1041 bp) | 320 (346 aa) |
| Codon optimized and Tyr to Phe mutated *Mortierella alpina* DGAT2 | 321 (1110 bp) | 322 (369 aa) |
| plasmid pKR278 | 323 (5303) | |
| plasmid pKR1274 | 324 (8358) | |
| Soybean thioesterase2 gene | 325 (1251) | |
| plasmid pTC4 | 326 (9592) | |
| plasmid pKR1258 | 331 (4738) | |
| Soybean Fad 2-1 gene | 332 (1164) | |
| plasmid pBS43 | 333 (10303) | |
| plasmid PCRblunt-Fad2-1 | 338 (4584) | |
| plasmid pKR1259 | 339 (5797) | |
| plasmid pKR1261 | 340 (7590) | |
| plasmid pKR123R | 341 (4993) | |
| plasmid pKR1266 | 342 (9036) | |
| plasmid pKR1267 | 343 (11615) | |
| plasmid pKR457 | 344 (5252) | |
| plasmid pKR1264 | 345 (9295) | |
| plasmid pKR1277 | 346 (2577) | |
| plasmid pKR1269 | 347 (9219) | |
| *Cryptococcus curvatus* DGAT2 gene | 350 (1506) | 351 (501) |

-continued

Summary Of Nucleic Acid And Protein SEQ ID Numbers

| Description and Abbreviation | Nucleic acid SEQ ID NO. (bp) | Protein SEQ ID NO. (aa) |
|---|---|---|
| plasmid pHD39 | 354 (5227) | |
| plasmid pKR1392 | 355 (8791) | |
| plasmid pKR1408 | 358 (4643) | |
| *Mucor circinelloides* DGAT2 gene | 359 (1110) | |
| plasmid pKR1409 | 360 (8206) | |
| plasmid pKR1427 | 361 (8602) | |
| *Cryptococcus curvatus* DGAT2 gene optimized for soy expression | 362 (1506) | 363 (501) |
| plasmid pKR1422 | 364 (8458) | |
| plasmid pKR1421 | 365 (8386) | |
| plasmid pKR1420 | 366 (9124) | |
| plasmid pKR1512 | 367 (8791) | |
| plasmid pKR1415 | 368 (8329) | |
| plasmid pKR1513 | 369 (8206) | |
| plasmid pKR1416 | 370 (8314) | |
| plasmid pKR1423 | 371 (8137) | |
| plasmid pKR1419 | 372 (8092) | |
| plasmid pKR1522 | 373 (8602) | |
| plasmid pKR1514 | 374 (8761) | |
| plasmid pKR1511 | 375 (8674) | |

SEQ ID NOs:7-8 correspond to PCR primers oYLD-GAT2-1 (SEQ ID NO:7) and oYLDGAT2-2 (SEQ IOD NO:8), used to amplify the *Yarrowia lipolytica* diacylglycerol acyltransferase 2 (YL DGAT2) gene from a yeast lysate (for details see Example 1.)

SEQ ID NOs:12-15 correspond to oligonucleotide primers used to amplify the coding regions of YL DGAT1 (YD-GAT1-F and YDGAT1-R; SEQ ID NOs:12-13, respectively) and YL DGAT2 (YDGAT2-F and YDGAT2-R, SEQ ID NOs:14-15, respectively) from *Yarrowia lipolytica* genomic DNA.

SEQ ID NOs:23 (oCal-15) and SEQ ID NO:24 (oCal-6) correspond to oligonucleotide primers used to amplify DNA fragment cal a24-4 (SEQ ID NO:22) from template plasmid CalFad2-2 described in PCT Publication No. WO 02/008269.

SEQ ID NO:28 (oKR85-1) and SEQ ID NO:29 (oKR85-2) correspond to primers used to amplify the beta-conglycinin promoter-(NotI cloning site)-phaseolin 3' terminator region from plasmid pKR85 (SEQ ID NO:27.)

SEQ ID NOs:37 (oGyl -1) and SEQ ID NO:38 (oGyl -2) correspond to primers used to amplify the soybean glycinin 1 promoter (SEQ ID NO:36) and incorporating BamHI and NcoI sites on the 5' and 3'-ends, respectively.

SEQ ID NO:54 (oP34-1) and SEQ ID NO:55 (oP34-2) correspond to primers used to amplify the soybean P34 promoter (SEQ ID NO:53) and incorporating BamHI and NotI sites into the 5' and 3'-ends, respectively.

SEQ ID NO:69 (oSGly-2) and SEQ ID NO:70 (oSGly-3) correspond to primers used to amplify the glycinin GY1 promoter.

SEQ ID NOs:76 (oYDG2-1) and SEQ ID NO:77 (oYDG2-2) correspond to primers used to amplify *Yarrowia* DGAT2 (SEQ ID NO:10) which was then incorporated into pKR1254 (SEQ ID NO:78).

SEQ ID NO:79 (YID2_Y326F-5) and SEQ ID NO:80 (YID2_Y326F-3) correspond to primers used to mutate the amino acid at position 326 of *Yarrowia* DGAT2 (SEQ ID NO:10) from tyrosine to phenylalanine.

SEQ ID NO:84 (YID2_Y326L-5) and SEQ ID NO:85 (YID2_Y326L-3) correspond to primers used to mutate the amino acid at position 326 of *Yarrowia* DGAT2 (SEQ ID NO:10) from tyrosine to leucine.

SEQ ID NO:89 (YID2_R327K-5) and SEQ ID NO:90 (YID2_R327K-3) correspond to primers used to mutate the amino acid at position 327 of *Yarrowia* DGAT2 (SEQ ID NO:10) from arginine to lysine.

SEQ ID NO:104 (MWG619) and SEQ ID NO:105 (MWG620) correspond to primers used to amplify 26S ribosomal DNA sequences.

SEQ ID NO:106 (primer 26S TD) is the 26S rDNA fragment isolated from *Torulaspora delbrueckii*. These sequencing fragments were used to identify the organisms from which the genomic DNA was isolated.

SEQ ID NOs:107-120 are degenerate primers used to amplify DGAT1 and DGAT2 genes from oleaginous organismal genomic DNA. See Table 37 in Example 18 for details.

SEQ ID NO:121 is the PCR fragment isolated from *Torulaspora delbrueckii* that was used as a probe to screen cosmid libraries. The translation of this fragment is shown in SEQ ID NO:122.

SEQ ID NOs:123-130 are sequencing primers used in characterizing the *Torulaspora delbrueckii* DGAT2 containing cosmid clones.

SEQ ID NO:137 is the 26S rDNA fragment isolated from *Pichia anomala.*

SEQ ID NO:138 is the PCR fragment isolated from *Pichia anomala* that was used as a probe to screen cosmid libraries. The translation of this fragment is shown in SEQ ID NO:139.

SEQ ID NOs:140-144 are sequencing primers used in characterizing the *Pichia anomala* DGAT2 containing cosmid clones.

SEQ ID NO:148 is the PCR fragment isolated from *Debaryomyces hansenii* that was used as a probe to screen cosmid libraries. The translation of this fragment is shown in SEQ ID NO:149.

SEQ ID NOs:150-159 are sequencing primers used in characterizing the *Debaryomyces hansenii* DGAT2 containing cosmid clones.

SEQ ID NO:163 is the 26S rDNA fragment isolated from *Candida zeylanoides.*

SEQ ID NO:164 is the PCR fragment isolated from *Candida zeylanoides* that was used as a probe to screen cosmid libraries. The translation of this fragment is shown in SEQ ID NO:165.

SEQ ID NOs:166-173 are sequencing primers used in characterizing the *Candida zeylanoides* DGAT2 containing cosmid clones.

SEQ ID NO:177 is the PCR fragment isolated from *Lipomyces starkeyi* that was used as a DGAT1 probe to screen cosmid libraries. The translation of this fragment is shown in SEQ ID NO:178.

SEQ ID NO:179 is the PCR fragment isolated from *Lipomyces starkeyi* that was used as a DGAT2 probe to screen cosmid libraries. The translation of this fragment is shown in SEQ ID NO:180.

SEQ ID NOs:181-188 are sequencing primers used in characterizing the *Lipomyces starkeyi* DGAT1 containing cosmid clones.

SEQ ID NOs:190-193 are sequencing primers used in characterizing the *Lipomyces starkeyi* DGAT2 containing cosmid clones.

SEQ ID NO:195 is the PCR fragment isolated from *Rhodotorula glutinis* that was used as a DGAT2 probe to screen cosmid libraries. The translation of this fragment is shown in SEQ ID NO:196.

SEQ ID NOs:197-203 are sequencing primers used in characterizing the *Rhodotorula glutinis* DGAT2 containing cosmid clones.

SEQ ID NO:205 is the PCR fragment isolated from *Phaffia rhodozyma* that encodes a partial DGAT2. The translation of this fragment is shown in SEQ ID NO:206.

SEQ ID NOs:207-213 are sequencing primers used in characterizing the *Phaffia rhodozyma* DGAT2 containing cosmid clones.

SEQ ID NO:216 is the PCR fragment isolated from *Cryptococcus curvatus* that was used as a DGAT2 probe to screen cosmid libraries. The translation of this fragment is shown in SEQ ID NO:217.

SEQ ID NOs:218-225 are sequencing primers used in characterizing the *Cryptococcus curvatus* DGAT2 containing cosmid clones.

SEQ ID NO:227 is the PCR fragment isolated from *Mucor circinelloides* that was used as a DGAT2 probe to screen cosmid libraries. The translation of this fragment is shown in SEQ ID NO:228.

SEQ ID NOs:229-232 are sequencing primers used in characterizing the *Mucor circinelloides* DGAT2 containing cosmid clones.

SEQ ID NOs:235-237 are primers used in amplifying the *Torulaspora delbrueckii* DGAT2a for cloning into plasmid pKR1324.

SEQ ID NOs:239-240 are primers used in amplifying the *Torulaspora delbrueckii* DGAT2b for cloning into plasmid pKR1325.

SEQ ID NOs:243-244 are primers used in amplifying the *Debaryomyces hansenii* DGAT2 for cloning into plasmid pKR1327.

SEQ ID NOs:243-244 are primers used in amplifying the *Mortierella alpina* DGAT2 for cloning into plasm id pKR1330.

SEQ ID NOs:257-258 are primers used in amplifying the *Pichia anomala* DGAT2 for cloning into plasm id pKR1319.

SEQ ID NOs:261-262 are primers used in amplifying the *Rhodotorula glutinis* DGAT2 for cloning into plasmid pHD28.

SEQ ID NOs:267-269 are primers used in amplifying the *Lipomyces starkeyi* DGAT2 for cloning into plasmid pHD30.

SEQ ID NOs:275-276 are primers used in amplifying the *Mortierella alpina* DGAT1 for cloning into plasmid pKR1329.

SEQ ID NOs:282-285 are primers used in the codon optimization of the *Yarrowia lipolytica* DGAT1 for cloning into plasmid pKR1310.

SEQ ID NOs:290-291 are primers used in the amplification of the *Phaffia rhodozyma* DGAT2 for cloning into plasmid pHD37.

SEQ ID NOs:295-296 are primers used in amplifying the *Lipomyces starkeyi* DGAT1 for cloning into plasmid pHD38.

SEQ ID NO:327-330 (GmTE2 5-1, GmTE2 3-1, GmTE2 5-2, and GmTE2 3-2, respectively) correspond to primers used to amplify the soybean thioesterase 2 gene.

SEQ ID NO:334-337 (GmFad2-1 5-1, GmFad2-1 3-1, GmFad2-1 5-2, and GmFad2-1 3-2, respectively) correspond to primers used to amplify the soybean fatty acid desaturase 2-1 gene.

SEQ ID NO:348-349 (CC ORF FWD and CC ORF REV, respectively) correspond to primers used to amplify the *Cryptococcus curvatus* diacylglyceride acyltransferase 2 gene.

SEQ ID NO:352-353 (CzDGAT2-5 and CzDGAT2-3, respectively) correspond to primers used to amplify the *Candida zeylanoides* diacylglyceride acyltransferase 2 gene.

SEQ ID NO:356-357 (oMcDG2-1 and oMcDG2-2, respectively) correspond to primers used to amplify the *Mucor circinelloides* diacylglyceride acyltransferase 2 gene.

DETAILED DESCRIPTION OF THE INVENTION

The disclosure of each reference set forth herein is hereby incorporated by reference in its entirety.

As used herein and in the appended claims, the singular forms "a", "an", and "the" include plural reference unless the context clearly dictates otherwise. Thus, for example, reference to "a plant" includes a plurality of such plants, reference to "a cell" includes one or more cells and equivalents thereof known to those skilled in the art, and so forth.

In the context of this disclosure, a number of terms and abbreviations are used. The following definitions are provided.

"Open reading frame" is abbreviated ORF.

"Polymerase chain reaction" is abbreviated PCR.

"American Type Culture Collection" is abbreviated ATCC.

Acyl-CoA:sterol-acyltransferase" is abbreviated ARE2.

"Phospholipid:diacylglycerol acyltransferase" is abbreviated PDAT.

"Diacylglycerol acyltransferase" is abbreviated DAG AT or DGAT.

"Diacylglycerol" is abbreviated DAG.

"Triacylglycerols" are abbreviated TAGs.

"Co-enzyme A" is abbreviated CoA.

The term "fatty acids" refers to long chain aliphatic acids (alkanoic acids) of varying chain length, from about $C_{12}$ to $C_{22}$ (although both longer and shorter chain-length acids are known). The predominant chain lengths are between $C_{16}$ and $C_{22}$. The structure of a fatty acid is represented by a simple notation system of "X:Y", where X is the total number of carbon (C) atoms in the particular fatty acid and Y is the number of double bonds.

Generally, fatty acids are classified as saturated or unsaturated. The term "saturated fatty acids" refers to those fatty acids that have no "double bonds" between their carbon backbone. In contrast, "unsaturated fatty acids" have "double bonds" along their carbon backbones (which are most commonly in the cis-configuration). "Monounsaturated fatty acids" have only one "double bond" along the carbon backbone (e.g., usually between the $9^{th}$ and $10^{th}$ carbon atom as for palmitoleic acid (16:1) and oleic acid (18:1)), while "polyunsaturated fatty acids" (or "PUFAs") have at least two double bonds along the carbon backbone (e.g., between the $9^{th}$ and $10^{th}$, and $12^{th}$ and $13^{th}$ carbon atoms for linoleic acid (18:2); and between the $9^{th}$ and $10^{th}$, $12^{th}$ and $13^{th}$, and $15^{th}$ and $16^{th}$ for α-linolenic acid (18:3)).

"Microbial oils" or "single cell oils" are those oils naturally produced by microorganisms (e.g., algae, oleaginous yeasts and filamentous fungi) during their lifespan. The term "oil" refers to a lipid substance that is liquid at 25° C. and usually polyunsaturated. In contrast, the term "fat" refers to a lipid substance that is solid at 25° C. and usually saturated.

"Lipid bodies" refer to lipid droplets that usually are bounded by specific proteins and a monolayer of phospholipid. These organelles are sites where most organisms transport/store neutral lipids. Lipid bodies are thought to arise from microdomains of the endoplasmic reticulum that contain TAG-biosynthesis enzymes; and, their synthesis and size appear to be controlled by specific protein components.

"Neutral lipids" refer to those lipids commonly found in cells in lipid bodies as storage fats and oils and are so called because at cellular pH, the lipids bear no charged groups. Generally, they are completely non-polar with no affinity for water. Neutral lipids generally refer to mono-, di-, and/or triesters of glycerol with fatty acids, also called monoacylglycerol, diacylglycerol or TAG, respectively (or collectively, acylglycerols). A hydrolysis reaction must occur to release free fatty acids from acylglycerols.

The terms "triacylglycerol", "oil" and "TAGs" refer to neutral lipids composed of three fatty acyl residues esterified to a glycerol molecule (and such terms will be used interchangeably throughout the present disclosure herein). Such oils can contain long chain PUFAs, as well as shorter saturated and unsaturated fatty acids and longer chain saturated fatty acids. Thus, "oil biosynthesis" generically refers to the synthesis of TAGs in the cell.

The term "DAG AT" or "DGAT" refers to a diacylglycerol acyltransferase (also known as an acyl-CoA-diacylglycerol acyltransferase or a diacylglycerol O-acyltransferase) (EC 2.3.1.20). This enzyme is responsible for the conversion of acyl-CoA and 1, 2-diacylglycerol to TAG and CoA (thereby involved in the terminal step of TAG biosynthesis). Two families of DAG AT enzymes exist: DGAT1 and DGAT2. The former family shares homology with the acyl-CoA:cholesterol acyltransferase (ACAT) gene family, while the latter family is unrelated (Lardizabal et al., *J. Biol. Chem.* 276(42): 38862-28869 (2001)).

The term "PDAT" refers to a phospholipid:diacylglycerol acyltransferase enzyme (EC 2.3.1.158). This enzyme is responsible for the transfer of an acyl group from the sn-2 position of a phospholipid to the sn-3 position of 1,2-diacylglycerol, thus resulting in lysophospholipid and TAG (thereby involved in the terminal step of TAG biosynthesis). This enzyme differs from DGAT (EC 2.3.1.20) by synthesizing TAG via an acyl-CoA-independent mechanism.

The term "ARE2" refers to an acyl-CoA: sterol-acyltransferase enzyme (EC 2.3.1.26; also known as a sterol-ester synthase 2 enzyme), catalyzing the following reaction: acyl-CoA+cholesterol=CoA+cholesterol ester.

As used herein, "nucleic acid" means a polynucleotide and includes single or double-stranded polymer of deoxyribonucleotide or ribonucleotide bases. Nucleic acids may also include fragments and modified nucleotides. Thus, the terms "polynucleotide", "nucleic acid sequence", "nucleotide sequence" or "nucleic acid fragment" are used interchangeably and is a polymer of RNA or DNA that is single- or double-stranded, optionally containing synthetic, non-natural or altered nucleotide bases. Nucleotides (usually found in their 5'-monophosphate form) are referred to by their single letter designation as follows: "A" for adenylate or deoxyadenylate (for RNA or DNA, respectively), "C" for cytidylate or deosycytidylate, "G" for guanylate or deoxyguanylate, "U" for uridlate, "T" for deosythymidylate, "R" for purines (A or G), "Y" for pyrimidiens (C or T), "K" for G or T, "H" for A or C or T, "I" for inosine, and "N" for any nucleotide.

The terms "subfragment that is functionally equivalent" and "functionally equivalent subfragment" are used interchangeably herein. These terms refer to a portion or subsequence of an isolated nucleic acid fragment in which the ability to alter gene expression or produce a certain phenotype is retained whether or not the fragment or subfragment encodes an active enzyme. For example, the fragment or subfragment can be used in the design of chimeric genes to produce the desired phenotype in a transformed plant. Chimeric genes can be designed for use in suppression by linking a nucleic acid fragment or subfragment thereof, whether or not it encodes an active enzyme, in the sense or antisense orientation relative to a plant promoter sequence.

The term "conserved domain" or "motif" means a set of amino acids conserved at specific positions along an aligned sequence of evolutionarily related proteins. While amino acids at other positions can vary between homologous proteins, amino acids that are highly conserved at specific positions indicate amino acids that are essential in the structure, the stability, or the activity of a protein. Because they are identified by their high degree of conservation in aligned sequences of a family of protein homologues, they can be used as identifiers, or "signatures", to determine if a protein with a newly determined sequence belongs to a previously identified protein family.

The terms "homology", "homologous", "substantially similar" and "corresponding substantially" are used interchangeably herein. They refer to nucleic acid fragments wherein changes in one or more nucleotide bases do not affect the ability of the nucleic acid fragment to mediate gene expression or produce a certain phenotype. These terms also refer to modifications of the nucleic acid fragments of the instant invention such as deletion or insertion of one or more nucleotides that do not substantially alter the functional properties of the resulting nucleic acid fragment relative to the initial, unmodified fragment. It is therefore understood, as those skilled in the art will appreciate, that the invention encompasses more than the specific exemplary sequences.

Moreover, the skilled artisan recognizes that substantially similar nucleic acid sequences encompassed by this invention are also defined by their ability to hybridize (under moderately stringent conditions, e.g., 0.5×SSC, 0.1% SDS, 60° C.) with the sequences exemplified herein, or to any portion of the nucleotide sequences disclosed herein and which are functionally equivalent to any of the nucleic acid sequences disclosed herein. Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 80% sequence identity, or 90% sequence identity, up to and including 100% sequence identity (i.e., fully complementary) with each other.

The term "stringent conditions" or "stringent hybridization conditions" includes reference to conditions under which a probe will selectively hybridize to its target sequence. Stringent conditions are sequence-dependent and will be different in different circumstances. By controlling the stringency of the hybridization and/or washing conditions, target sequences can be identified which are 100% complementary to the probe (homologous probing). Alternatively, stringency conditions can be adjusted to allow some mismatching in sequences so that lower degrees of similarity are detected (heterologous probing). Generally, a probe is less than about 1000 nucleotides in length, optionally less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C.

Specificity is typically the function of post-hybridization washes, the critical factors being the ionic strength and temperature of the final wash solution. For DNA-DNA hybrids, the $T_m$ can be approximated from the equation of Meinkoth et al., *Anal. Biochem.* 138:267-284 (1984): $T_m$=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization and/or wash conditions can be adjusted to hybridize to sequences of the desired identity. For example, if sequences with ≧90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution) it is preferred to increase the SSC concentration so that a higher temperature can be used. An extensive guide to the hybridization of nucleic acids is found in Tijssen, *Laboratory Techniques in Biochemistry and Molecular Biology—Hybridization with Nucleic Acid Probes*, Part I, Chapter 2 "Overview of principles of hybridization and the strategy of nucleic acid probe assays", Elsevier, N.Y. (1993); and Current Protocols in Molecular Biology, Chapter 2, Ausubel et al., Eds., Greene Publishing and Wiley-Interscience, New York (1995). Hybridization and/or wash conditions can be applied for at least 10, 30, 60, 90, 120, or 240 minutes.

"Sequence identity" or "identity" in the context of nucleic acid or polypeptide sequences refers to the nucleic acid bases or amino acid residues in two sequences that are the same when aligned for maximum correspondence over a specified comparison window.

Thus, "percentage of sequence identity" refers to the value determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the results by 100 to yield the percentage of sequence identity. Useful examples of percent sequence identities include, but are not limited to, 50%, 55%, 60%, 65%, 70%, 75%, 80%, 85%, 90%, or 95%, or any integer percentage from 50% to 100%. These identities can be determined using any of the programs described herein.

Sequence alignments and percent identity or similarity calculations may be determined using a variety of comparison methods designed to detect homologous sequences including, but not limited to, the MegAlign™ program of the LASERGENE bioinformatics computing suite (DNASTAR Inc., Madison, Wis.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

The "Clustal V method of alignment" corresponds to the alignment method labeled Clustal V (described by Higgins and Sharp, *CABIOS.* 5:151-153 (1989); Higgins, D. G. et al. (1992) *Comput. Appl. Biosci.* 8:189-191) and found in the MegAlign™ program of the LASERGENE bioinformatics computing suite (DNASTAR Inc., Madison, Wis.). For multiple alignments, the default values correspond to GAP PENALTY=10 and GAP LENGTH PENALTY=10. Default parameters for pairwise alignments and calculation of percent identity of protein sequences using the Clustal method are KTUPLE=1, GAP PENALTY=3, WINDOW=5 and DIAGONALS SAVED=5. For nucleic acids these parameters are KTUPLE=2, GAP PENALTY=5, WINDOW=4 and DIAGONALS SAVED=4. After alignment of the sequences using the Clustal V program, it is possible to obtain a "percent identity" by viewing the "sequence distances" table in the same program.

"BLASTN method of alignment" is an algorithm provided by the National Center for Biotechnology Information (NCBI) to compare nucleotide sequences using default parameters.

It is well understood by one skilled in the art that many levels of sequence identity are useful in identifying polypeptides, from other species, wherein such polypeptides have the same or similar function or activity. Useful examples of percent identities include, but are not limited to, 50%, 55%, 60%, 65%, 70%, 75%, 80%, 85%, 90%, or 95%, or any integer percentage from 50% to 100%. Indeed, any integer amino acid identity from 50% to 100% may be useful in describing the present invention, such as 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%. Also, of interest is any full-length or partial complement of this isolated nucleotide fragment.

"Gene" refers to a nucleic acid fragment that expresses a specific protein, including regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. A "foreign" gene refers to a gene not normally found in the host organism, but that is introduced into the host organism by gene transfer. Foreign genes can comprise native genes inserted into a non-native organism, or chimeric genes. A "transgene" is a gene that has been introduced into the genome by a transformation procedure.

The term "genome" as it applies to a plant cells encompasses not only chromosomal DNA found within the nucleus, but organelle DNA found within subcellular components (e.g., mitochondrial, plastid) of the cell.

A "codon-optimized gene" is a gene having its frequency of codon usage designed to mimic the frequency of preferred codon usage of the host cell.

An "allele" is one of several alternative forms of a gene occupying a given locus on a chromosome. When all the alleles present at a given locus on a chromosome are the same that plant is homozygous at that locus. If the alleles present at a given locus on a chromosome differ that plant is heterozygous at that locus.

"Coding sequence" refers to a DNA sequence that codes for a specific amino acid sequence. "Regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include, but are not limited to: promoters, translation leader sequences, introns, polyadenylation recognition sequences, RNA processing sites, effector binding sites and stem-loop structures.

"Promoter" refers to a DNA sequence capable of controlling the expression of a coding sequence or functional RNA. The promoter sequence consists of proximal and more distal upstream elements, the latter elements often referred to as enhancers. Accordingly, an "enhancer" is a DNA sequence that can stimulate promoter activity, and may be an innate element of the promoter or a heterologous element inserted to enhance the level or tissue-specificity of a promoter. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions. It is further recognized that since in most cases the exact boundaries of regulatory sequences have not been completely defined, DNA fragments of some variation may have identical promoter activity. Promoters that cause a gene to be expressed in most cell types at most times are commonly referred to as "constitutive promoters". New promoters of various types useful in plant cells are constantly being discovered; numerous examples may be found in the compilation by Okamuro, J. K., and Goldberg, R. B. *Biochemistry of Plants* 15:1-82 (1989).

"Translation leader sequence" refers to a polynucleotide sequence located between the promoter sequence of a gene and the coding sequence. The translation leader sequence is present in the fully processed mRNA upstream of the translation start sequence. The translation leader sequence may affect processing of the primary transcript to mRNA, mRNA stability or translation efficiency. Examples of translation leader sequences have been described (Turner, R. and Foster, G. D., *Mol. Biotechnol.* 3:225-236 (1995)).

"3' non-coding sequences", "transcription terminator" or "termination sequences" refer to DNA sequences located downstream of a coding sequence and include polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The use of different 3' non-coding sequences is exemplified by Ingelbrecht, I. L., et al. *Plant Cell* 1:671-680 (1989).

"RNA transcript" refers to the product resulting from RNA polymerase-catalyzed transcription of a DNA sequence. When the RNA transcript is a perfect complementary copy of the DNA sequence, it is referred to as the primary transcript. A RNA transcript is referred to as the mature RNA when it is a RNA sequence derived from post-transcriptional processing of the primary transcript. "Messenger RNA" or "mRNA" refers to the RNA that is without introns and that can be translated into protein by the cell. "cDNA" refers to a DNA that is complementary to, and synthesized from, a mRNA template using the enzyme reverse transcriptase. The cDNA can be single-stranded or converted into double-stranded form using the Klenow fragment of DNA polymerase I. "Sense" RNA refers to RNA transcript that includes the mRNA and can be translated into protein within a cell or in vitro. "Antisense RNA" refers to an RNA transcript that is complementary to all or part of a target primary transcript or mRNA, and that blocks the expression of a target gene (U.S. Pat. No. 5,107,065). The complementarity of an antisense RNA may be with any part of the specific gene transcript, i.e., at the 5' non-coding sequence, 3' non-coding sequence, introns, or the coding sequence. "Functional RNA" refers to antisense RNA, ribozyme RNA, or other RNA that may not be translated but yet has an effect on cellular processes. The terms "complement" and "reverse complement" are used interchangeably herein with respect to mRNA transcripts, and are meant to define the antisense RNA of the message.

The term "operably linked" refers to the association of nucleic acid sequences on a single nucleic acid fragment so that the function of one is regulated by the other. For example, a promoter is operably linked with a coding sequence when it is capable of regulating the expression of that coding sequence (i.e., the coding sequence is under the transcriptional control of the promoter). Coding sequences can be operably linked to regulatory sequences in a sense or antisense orientation. In another example, the complementary RNA regions of the invention can be operably linked, either directly or indirectly, 5' to the target mRNA, or 3' to the target mRNA, or within the target mRNA, or a first complementary region is 5' and its complement is 3' to the target mRNA.

Standard recombinant DNA and molecular cloning techniques used herein are well known in the art and are described more fully in Sambrook, J., Fritsch, E. F. and Maniatis, T. Molecular Cloning: A Laboratory Manual; Cold Spring Harbor Laboratory: Cold Spring Harbor, N.Y. (1989). Transformation methods are well known to those skilled in the art and are described infra.

"PCR" or "polymerase chain reaction" is a technique for the synthesis of large quantities of specific DNA segments and consists of a series of repetitive cycles (Perkin Elmer Cetus Instruments, Norwalk, Conn.). Typically, the double-stranded DNA is heat denatured, the two primers complementary to the 3' boundaries of the target segment are annealed at low temperature and then extended at an intermediate temperature. One set of these three consecutive steps is referred to as a "cycle".

The term "recombinant" refers to an artificial combination of two otherwise separated segments of sequence, e.g., by chemical synthesis or by the manipulation of isolated segments of nucleic acids by genetic engineering techniques.

The terms "plasmid", "vector" and "cassette" refer to an extra chromosomal element often carrying genes that are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. "Transformation cassette" refers to a specific vector containing a foreign gene and having elements in addition to the foreign gene that facilitates transformation of a particular host cell. "Expression cassette" refers to a specific vector containing a foreign gene and having elements in addition to the foreign gene that allow for enhanced expression of that gene in a foreign host (i.e., to a discrete nucleic acid fragment into which a nucleic acid sequence or fragment can be moved.)

The terms "recombinant construct", "expression construct", "chimeric construct", "construct", and "recombinant DNA construct" are used interchangeably herein. A recombinant construct comprises an artificial combination of nucleic acid fragments, e.g., regulatory and coding sequences that are not found together in nature. For example, a chimeric construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments of the invention. The skilled artisan will also recognize that different independent transformation events will result in different levels and patterns of expression (Jones et al., EMBO J. 4:2411-2418 (1985); De Almeida et al., Mol. Gen. Genetics 218:78-86 (1989)), and thus that multiple events must be screened in order to obtain lines displaying the desired expression level and pattern. Such screening may be accomplished by Southern analysis of DNA, Northern analysis of mRNA expression, immunoblotting analysis of protein expression, or phenotypic analysis, among others.

The term "expression", as used herein, refers to the production of a functional end-product (e.g., a mRNA or a protein [either precursor or mature]).

The term "introduced" means providing a nucleic acid (e.g., expression construct) or protein into a cell. Introduced includes reference to the incorporation of a nucleic acid into a eukaryotic or prokaryotic cell where the nucleic acid may be incorporated into the genome of the cell, and includes reference to the transient provision of a nucleic acid or protein to the cell. Introduced includes reference to stable or transient transformation methods, as well as sexually crossing. Thus, "introduced" in the context of inserting a nucleic acid fragment (e.g., a recombinant DNA construct/expression construct) into a cell, means "transfection" or "transformation" or "transduction" and includes reference to the incorporation of a nucleic acid fragment into a eukaryotic or prokaryotic cell where the nucleic acid fragment may be incorporated into the genome of the cell (e.g., chromosome, plasmid, plastid or mitochondrial DNA), converted into an autonomous replicon, or transiently expressed (e.g., transfected mRNA).

"Mature" protein refers to a post-translationally processed polypeptide (i.e., one from which any pre- or propeptides present in the primary translation product have been removed). "Precursor" protein refers to the primary product of translation of mRNA (i.e., with pre- and propeptides still present). Pre- and propeptides may be but are not limited to intracellular localization signals.

"Stable transformation" refers to the transfer of a nucleic acid fragment into a genome of a host organism, including both nuclear and organellar genomes, resulting in genetically stable inheritance. In contrast, "transient transformation" refers to the transfer of a nucleic acid fragment into the nucleus, or DNA-containing organelle, of a host organism resulting in gene expression without integration or stable inheritance. Host organisms containing the transformed nucleic acid fragments are referred to as "transgenic" organisms.

As used herein, "transgenic" refers to a plant or a cell which comprises within its genome a heterologous polynucleotide. Preferably, the heterologous polynucleotide is stably integrated within the genome such that the polynucleotide is passed on to successive generations. The heterologous polynucleotide may be integrated into the genome alone or as part of an expression construct. Transgenic is used herein to include any cell, cell line, callus, tissue, plant part or plant, the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition, or spontaneous mutation.

"Antisense inhibition" refers to the production of antisense RNA transcripts capable of suppressing the expression of the target protein. "Co-suppression" refers to the production of sense RNA transcripts capable of suppressing the expression of identical or substantially similar foreign or endogenous genes (U.S. Pat. No. 5,231,020). Co-suppression constructs in plants previously have been designed by focusing on overexpression of a nucleic acid sequence having homology to an endogenous mRNA, in the sense orientation, which results in the reduction of all RNA having homology to the overexpressed sequence (Vaucheret et al., Plant J. 16:651-659 (1998); Gura, Nature 404:804-808 (2000)). The overall efficiency of this phenomenon is low, and the extent of the RNA reduction is widely variable. More recent work has described the use of "hairpin" structures that incorporate all, or part, of an mRNA encoding sequence in a complementary orientation that results in a potential "stem-loop" structure for the expressed RNA (PCT Publication No. WO 99/53050, published Oct. 21, 1999; PCT Publication No. WO 02/00904, published Jan. 3, 2002). This increases the frequency of co-suppression in the recovered transgenic plants. Another variation describes the use of plant viral sequences to direct the suppression, or "silencing", of proximal mRNA encoding sequences (PCT Publication No. WO 98/36083, published Aug. 20, 1998). Both of these co-suppressing phenomena have not been elucidated mechanistically, although genetic evidence has begun to unravel this complex situation (Elmayan et al., *Plant Cell* 10:1747-1757 (1998)).

The term "oleaginous" refers to those organisms that tend to store their energy source in the form of lipid (Weete, In: Fungal Lipid Biochemistry, $2^{nd}$ Ed., Plenum, 1980). A class of plants identified as oleaginous are commonly referred to as "oilseed" plants. Examples of oilseed plants include, but are not limited to: soybean (*Glycine* and *Soja* sp.), flax (*Linum* sp.), rapeseed (*Brassica* sp.), maize, cotton, safflower (*Carthamus* sp.) and sunflower (*Helianthus* sp.).

Within oleaginous microorganisms the cellular oil or TAG content generally follows a sigmoid curve, wherein the concentration of lipid increases until it reaches a maximum at the late logarithmic or early stationary growth phase and then gradually decreases during the late stationary and death phases (Yongmanitchai and Ward, *Appl. Environ. Microbiol.* 57:419-25 (1991)).

Also described herein are oleaginous microbial organisms produced by the methods described herein. This therefore includes oleaginous bacteria, algae, moss, euglenoids, stramenopiles fungi and yeast, comprising in their genome a recombinant construct incorporating an isolated nucleic acid of the present invention. Additionally, lipids and oils obtained from these oleaginous organisms, products obtained from the processing of the lipids and oil, use of these lipids and oil in foods, animal feeds or industrial applications and/or use of the by-products in foods or animal feeds are also described. Oleaginous microalgae also exist with the capability of producing oil contents of 20 to 50% of their total dry weight, especially under stress conditions (Hu et al, 2008, Plant J 54:621-639). Examples of microalgae include, but are not limited to *Rhodomonas salina, Crypthecodinium cohnii, Chaetoceros lauderi Paviova pinguis*, and *Emiliania huxleyi*. There is currently great interest in using oleaginous microalgae to produce oil for biofuels, or for use as nutraceuticals or cosmetics (Hu et al, 2008, Plant J 54:621-639; Waltz, 2009, Nature Biotechnology 27: 15-18.) The approach of overexpressing genes in microalgae to improve oil production for biofuels applications is being explored (Waltz, 2009, Nature Biotchnology 27:15-18.)

The term "oleaginous yeast" refers to those microorganisms classified as yeasts that make oil. It is not uncommon for oleaginous microorganisms to accumulate in excess of about 25% of their dry cell weight as oil. Examples of oleaginous yeast include, but are no means limited to, the following genera: *Yarrowia, Candida, Rhodotorula, Rhodosporidium, Cryptococcus, Trichosporon* and *Lipomyces*.

The term "plant" refers to whole plants, plant organs, plant tissues, seeds, plant cells, seeds and progeny of the same. Plant cells include, without limitation, cells from seeds, suspension cultures, embryos, meristematic regions, callus tissue, leaves, roots, shoots, gametophytes, sporophytes, pollen and microspores.

"Progeny" comprises any subsequent generation of a plant.

"Non-transgenic, null segregant soybean seed" refers to a near isogenic plant or seed that lacks the transgene, and/or a parental plant used in the transformation process to obtain the transgenic event. Null segregants can be plants or seed that do not contain the transgenic trait due to normal genetic segregation during propagation of the heterozygous transgenic plants.

A "kernel" is the corn caryopsis, consisting of a mature embryo and endosperm which are products of double fertilization. The term "corn" or "maize" represents any variety, cultivar, or population of *Zea mays* L.

"Grain" comprises mature corn kernels produced by commercial growers for on farm use or for sale to customers in both cases for purposes other than growing or reproducing the species. The "seed" is the mature corn kernel produced for the purpose of propagating the species and for sale to commercial growers. As used herein the terms seeds, kernels, and grains can be used interchangeably. The "embryo" or also termed "germ" is a young sporophytic plant, before the start of a period of rapid growth (seed germination). The embryo (germ) of corn contains the vast majority of the oil found in the kernel. The structure of embryo in cereal grain includes the embryonic axis and the scutellum. The "scutellum" is the single cotyledon of a cereal grain embryo, specialized for absorption of the endosperm. The "aleurone" is a proteinaceous material, usually in the form of small granules, occurring in the outermost cell layer of the endosperm of corn and other grains.

The present invention concerns a transgenic soybean seed having increased total fatty acid content of at least 10% when compared to the total fatty acid content of a non-transgenic, null segregant soybean seed. It is understood that any measurable increase in the total fatty acid content of a transgenic versus a non-transgenic, null segregant would be useful. Such increases in the total fatty acid content would include, but are not limited to, at least 1%, 2%, 3%, 4%, 5%, 6%, 7%, 8%, 9%, 11%, 12%, 13%, 14%, 15%, 16%, 17%, 18%, 19%, or 20%.

A transgenic oilseed of the invention can comprise a recombinant construct having at least one DGAT sequence. This DGAT sequence can be selected from the group consisting of DGAT1, DGAT2 and DGAT1 in combination with DGAT2. Furthermore, at least one DGAT sequence can be from *Yarrowia*. Examples of suitable DGAT sequences that can be used to practice the invention are discussed in the Examples below. There can be mentioned SEQ ID NOs: 133, 134, 146, 161, 175, 214, 233, 264, 271, 278, 298, 301, 303, 305, 307, 309, 311, 313, 315, 317, 319, 321, 350, 352, or 362 in the present invention. Those skilled in the art will appreciate that the instant invention includes, but is not limited to, the DGAT sequences disclosed herein.

Such a recombinant construct promoter would comprise different components such as a promoter which is a DNA sequence that directs cellular machinery of a plant to produce RNA from the contiguous coding sequence downstream (3') of the promoter. The promoter region influences the rate, developmental stage, and cell type in which the RNA transcript of the gene is made. The RNA transcript is processed to produce mRNA which serves as a template for translation of the RNA sequence into the amino acid sequence of the encoded polypeptide. The 5' non-translated leader sequence is a region of the mRNA upstream of the protein coding region that may play a role in initiation and translation of the mRNA. The 3' transcription termination/polyadenylation signal is a non-translated region downstream of the protein coding region that functions in the plant cell to cause termination of the RNA transcript and the addition of polyadenylate nucleotides to the 3' end of the RNA.

The origin of the promoter chosen to drive expression of the DGAT coding sequence is not important as long as it has sufficient transcriptional activity to accomplish the invention by expressing translatable mRNA for the desired nucleic acid fragments in the desired host tissue at the right time. Either heterologous or non-heterologous (i.e., endogenous) promoters can be used to practice the invention. For example, suitable promoters include, but are not limited to: the alpha prime subunit of beta conglycinin promoter, the Kunitz trypsin inhibitor 3 promoter, the annexin promoter, the glycinin Gy1 promoter, the beta subunit of beta conglycinin promoter, the P34/Gly Bd m 30K promoter, the albumin promoter, the Leg A1 promoter and the Leg A2 promoter.

The annexin, or P34, promoter is described in PCT Publication No. WO 2004/071178 (published Aug. 26, 2004). The level of activity of the annexin promoter is comparable to that of many known strong promoters, such as: (1) the CaMV 35S promoter (Atanassova et al., *Plant Mol. Biol.* 37:275-285 (1998); Battraw and Hall, *Plant Mol. Biol.* 15:527-538 (1990); Holtorf et al., *Plant Mol. Biol.* 29:637-646 (1995); Jefferson et al., *EMBO J.* 6:3901-3907 (1987); Wilmink et al., *Plant Mol. Biol.* 28:949-955 (1995)); (2) the *Arabidopsis* oleosin promoters (Plant et al., *Plant Mol. Biol.* 25:193-205 (1994); Li, Texas A&M University Ph.D. dissertation, pp. 107-128 (1997)); (3) the *Arabidopsis* ubiquitin extension protein promoters (Callis et al., *J. Biol. Chem.* 265(21):12486-93 (1990)); (4) a tomato ubiquitin gene promoter (Rollfinke et al., *Gene.* 211(2):267-76 (1998)); (5) a soybean heat shock protein promoter (Schoffl et al., *Mol Gen Genet.* 217 (2-3): 246-53 (1989)); and, (6) a maize H3 histone gene promoter (Atanassova et al., *Plant Mol. Biol.* 37(2):275-85 (1989)).

Another useful feature of the annexin promoter is its expression profile in developing seeds. The annexin promoter is most active in developing seeds at early stages (before 10 days after pollination) and is largely quiescent in later stages. The expression profile of the annexin promoter is different from that of many seed-specific promoters, e.g., seed storage protein promoters, which often provide highest activity in later stages of development (Chen et al., *Dev. Genet.* 10:112-122 (1989); Ellerstrom et al., *Plant Mol. Biol.* 32:1019-1027 (1996); Keddie et al., *Plant Mol. Biol.* 24:327-340 (1994); Plant et al., (supra); Li, (supra)). The annexin promoter has a more conventional expression profile but remains distinct from other known seed specific promoters. Thus, the annexin promoter will be a very attractive candidate when overexpression, or suppression, of a gene in embryos is desired at an early developing stage. For example, it may be desirable to overexpress a gene regulating early embryo development or a gene involved in the metabolism prior to seed maturation.

Following identification of an appropriate promoter suitable for expression of a specific DGAT-coding sequence, the promoter is then operably linked in a sense orientation using conventional means well known to those skilled in the art.

Standard recombinant DNA and molecular cloning techniques used herein are well known in the art and are described more fully in Sambrook, J. et al., In *Molecular Cloning: A Laboratory Manual*; 2$^{nd}$ ed.; Cold Spring Harbor Laboratory Press: Cold Spring Harbor, N.Y., 1989 (hereinafter "Sambrook et al., 1989") or Ausubel, F. M., Brent, R., Kingston, R. E., Moore, D. D., Seidman, J. G., Smith, J. A. and Struhl, K., Eds.; In *Current Protocols in Molecular Biology*; John Wiley and Sons: New York, 1990 (hereinafter "Ausubel et al., 1990").

In another aspect, this invention concerns a method method for increasing the total fatty acid content of a soybean seed comprising:

(a) transforming at least one soybean cell with a recombinant construct having at least one DGAT sequence;

(b) selecting the transformed soybean cell(s) of step (a) having an increased total fatty acid content of at least 10% when compared to the total fatty acid content of a non-transgenic, null segregant soybean seed.

Once the recombinant construct has been made, it may then be introduced into a plant cell of choice by methods well known to those of ordinary skill in the art (e.g., transfection, transformation and electroporation). Oilseed plant cells are the preferred plant cells. The transformed plant cell is then cultured and regenerated under suitable conditions permitting selection of those transformed soybean cell(s) having an increased total fatty acid content of at least 10% when compared to the total fatty acid content of a non-transgenic, null segregant soybean seed.

Such recombinant constructs may be introduced into one plant cell; or, alternatively, each construct may be introduced into separate plant cells.

Expression in a plant cell may be accomplished in a transient or stable fashion as is described above.

Also within the scope of this invention are seeds or plant parts obtained from such transformed plants.

Plant parts include differentiated and undifferentiated tissues including, but not limited to the following: roots, stems, shoots, leaves, pollen, seeds, tumor tissue and various forms of cells and culture (e.g., single cells, protoplasts, embryos and callus tissue). The plant tissue may be in plant or in a plant organ, tissue or cell culture.

The term "plant organ" refers to plant tissue or a group of tissues that constitute a morphologically and functionally distinct part of a plant. The term "genome" refers to the following: (1) the entire complement of genetic material (genes and non-coding sequences) that is present in each cell of an organism, or virus or organelle; and/or (2) a complete set of chromosomes inherited as a (haploid) unit from one parent.

Methods for transforming dicots (primarily by use of *Agrobacterium tumefaciens*) and obtaining transgenic plants have been published, among others, for: cotton (U.S. Pat. No. 5,004,863; U.S. Pat. No. 5,159,135); soybean (U.S. Pat. No. 5,569,834; U.S. Pat. No. 5,416,011); *Brassica* (U.S. Pat. No. 5,463,174); peanut (Cheng et al. *Plant Cell Rep.* 15:653-657 (1996); McKently et al. *Plant Cell Rep.* 14:699-703 (1995)); papaya (Ling, K. et al. *Bio/technology* 9:752-758 (1991)); and pea (Grant et al. *Plant Cell Rep.* 15:254-258 (1995)). For a review of other commonly used methods of plant transformation see Newell, C. A. (*Mol. Biotechnol.* 16:53-65 (2000)). One of these methods of transformation uses *Agrobacterium rhizogenes* (Tepfler, M. and Casse-Delbart, F. *Microbiol. Sci.* 4:24-28 (1987)). Transformation of soybeans using direct delivery of DNA has been published using PEG fusion (PCT Publication No. WO 92/17598), electroporation (Chowrira, G. M. et al., *Mol. Biotechnol.* 3:17-23 (1995); Christou, P. et al., *Proc. Natl. Acad. Sci.* U.S.A. 84:3962-3966 (1987)), microinjection and particle bombardment (McCabe, D. E. et. al., *Bio/Technology* 6:923 (1988); Christou et al., *Plant Physiol.* 87:671-674 (1988)).

There are a variety of methods for the regeneration of plants from plant tissue. The particular method of regeneration will depend on the starting plant tissue and the particular plant species to be regenerated. The regeneration, development and cultivation of plants from single plant protoplast transformants or from various transformed explants is well known in the art (Weissbach and Weissbach, In: Methods for Plant Molecular Biology, (Eds.), Academic: San Diego, Calif. (1988)). This regeneration and growth process typically includes the steps of selection of transformed cells and culturing those individualized cells through the usual stages of embryonic development through the rooted plantlet stage.

Transgenic embryos and seeds are similarly regenerated. The resulting transgenic rooted shoots are thereafter planted in an appropriate plant growth medium such as soil. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

In addition to the above discussed procedures, practitioners are familiar with the standard resource materials which describe specific conditions and procedures for: the construction, manipulation and isolation of macromolecules (e.g., DNA molecules, plasmids, etc.); the generation of recombinant DNA fragments and recombinant expression constructs; and, the screening and isolating of clones. See, for example: Sambrook et al., Molecular Cloning: A Laboratory Manual, Cold Spring Harbor: NY (1989); Maliga et al., Methods in Plant Molecular Biology, Cold Spring Harbor: NY (1995); Birren et al., Genome Analysis: Detecting Genes, Vol. 1, Cold Spring Harbor: NY (1998); Birren et al., Genome Analysis: Analyzing DNA, Vol. 2, Cold Spring Harbor: NY (1998); Plant Molecular Biology: A Laboratory Manual, eds. Clark, Springer: NY (1997).

Examples of oilseed plants include, but are not limited to: soybean, *Brassica* species, sunflower, maize, cotton, flax and safflower.

In another aspect, this invention concerns a a transgenic corn kernel having increased total fatty acid content of at least 10% when compared to the total fatty acid content of a non-transgenic, null segregant corn kernel. Such a transgenic corn kernel can comprise a recombinant construct having at least one DGAT sequence. This DGAT sequence can be selected from the group consisting of DGAT1, DGAT2, or DGAT1 in combination with DGAT2.

In still another aspect, the present invention concerns a method for increasing the total fatty acid content of a corn kernel comprising:
(a) transforming at least one corn kernel with a recombinant construct having at least one DGAT sequence;
(b) selecting the transformed corn kernel(s) of step (a) having an increased total fatty acid content of at least 10% when compared to the total fatty acid content of a non-transgenic, null segregant corn kernel.

The present invention also concerns a transgenic soybean seed having increased total fatty acid content of at least 10% and an increased oleic acid content of at least 25% when compared to the total fatty acid content and oleic acid content of a non-transgenic, null segregant soybean seed. And the present invention further concerns a transgenic soybean having increased total fatty acid content of at least 10% and at least any one of i) an increased oleic acid content of at least 25%; ii) a decreased linolenic acid content of at least 25%; iii) a decreased linoleic acid content of at least 4%; iv) a decreased palmitic acid content of at least 8%; and v) an increased stearic acid content of at lease 14% when compared to the total fatty acid content and oleic, linolenic acid, linoleic acid, palmitic acid or stearic acid, respectively, content of a non-transgenic, null segregant soybean seed.

In still a further aspect, the present invention also concerns a method for increasing the total fatty acid content and oleic acid content of a soybean seed comprising:
(a) transforming at least one soybean cell with a recombinant construct having at least one DGAT sequence;
(b) selecting the transformed soybean cell(s) of step (a) having an increased total fatty acid content of at least 10% and an increased oleic acid content of at least 25% when compared to the total fatty acid content and oleic acid content of a non-transgenic, null segregant soybean seed.

In still yet a further aspect, the present invention concerns a method for increasing the total fatty acid content and decreasing linolenic acid content of a soybean seed comprising:
(a) transforming at least one soybean cell with a recombinant construct having at least one DGAT sequence;
(b) selecting the transformed soybean cell(s) of step (a) having an increased total fatty acid content of at least 10% and a decreased linolenic acid content of at least 25% when compared to the total fatty acid content and oleic acid content of a non-transgenic, null segregant soybean seed.

Yet again in a further aspect, the present invention concerns a method for increasing the total fatty acid content and decreasing linoleic acid content of a soybean seed comprising:
(a) transforming at least one soybean cell with a recombinant construct having at least one DGAT sequence;
(b) selecting the transformed soybean cell(s) of step (a) having an increased total fatty acid content of at least 10% and a decreased linoleic acid content of at least 4% when compared to the total fatty acid content and oleic acid content of a non-transgenic, null segregant soybean seed.

Again in a further aspect, the present invention concerns a method for increasing the total fatty acid content and decreased palmitic acid content of a soybean seed comprising:
(a) transforming at least one soybean cell with a recombinant construct having at least one DGAT sequence;
(b) selecting the transformed soybean cell(s) of step (a) having an increased total fatty acid content of at least 10% and a decreased palmitic acid content of at least 8% when compared to the total fatty acid content and oleic acid content of a non-transgenic, null segregant soybean seed.

In yet another aspect, the present invention concerns a method for increasing the total fatty acid content and stearic acid content of a soybean seed comprising:
(a) transforming at least one soybean cell with a recombinant construct having at least one DGAT sequence;
(b) selecting the transformed soybean cell(s) of step (a) having an increased total fatty acid content of at least 10% and an increased stearic acid content of at least 14% when compared to the total fatty acid content and oleic acid content of a non-transgenic, null segregant soybean seed.

As was discussed above, any of the transgenic oilseeds discussed herein can comprise a recombinant construct having at least one DGAT sequence. This DGAT sequence can be selected from the group consisting of DGAT1, DGAT2, or DGAT1 in combination with DGAT2. Furthermore, at least one DGAT sequence is from *Yarrowia*.

Transformation of monocotyledons using electroporation, particle bombardment, and *Agrobacterium* have been reported. Transformation and plant regeneration have been achieved in asparagus (Bytebier et al., *Proc. Natl. Acad. Sci.* (USA) 84:5354, (1987)); barley (Wan and Lemaux, *Plant Physiol* 104:37 (1994)); *Zea mays* (Rhodes et al., *Science* 240:204 (1988), Gordon-Kamm et al., *Plant Cell* 2:603-618 (1990), Fromm et al., *Bio/Technology* 8:833 (1990), Koziel et al., *Bio/Technology* 11: 194, (1993), Armstrong et al., *Crop Science* 35:550-557 (1995)); oat (Somers et al., *Bio/Technology* 10: 15 89 (1992)); orchard grass (Horn et al., *Plant Cell Rep.* 7:469 (1988)); rice (Toriyama et al., *TheorAppl. Genet.* 205:34, (1986); Part et al., *Plant Mol. Biol.* 32:1135-1148, (1996); Abedinia et al., *Aust. J. Plant Physiol.* 24:133-141 (1997); Zhang and Wu, *Theor. Appl. Genet.* 76:835 (1988); Zhang et al. *Plant Cell Rep.* 7:379, (1988); Battraw and Hall, *Plant Sci.* 86:191-202 (1992); Christou et al., *Bio/Technology* 9:957 (1991)); rye (De la Pena et al., *Nature* 325:274 (1987)); sugarcane (Bower and Birch, *Plant J.* 2:409 (1992)); tall fescue (Wang et al., *Bio/Technology* 10:691 (1992)), and wheat (Vasil et al., *Bio/Technology* 10:667 (1992); U.S. Pat. No. 5,631,152).

Assays for gene expression based on the transient expression of cloned nucleic acid constructs have been developed by introducing the nucleic acid molecules into plant cells by polyethylene glycol treatment, electroporation, or particle bombardment (Marcotte et al., *Nature* 335:454-457 (1988); Marcotte et al., *Plant Cell* 1:523-532 (1989); McCarty et al., *Cell* 66:895-905 (1991); Hattori et al., *Genes Dev.* 6:609-618 (1992); Goff et al., *EMBO J.* 9:2517-2522 (1990)).

Transient expression systems may be used to functionally dissect gene constructs (see generally, Maliga et al., Methods in Plant Molecular Biology, Cold Spring Harbor Press (1995)). It is understood that any of the nucleic acid molecules of the present invention can be introduced into a plant cell in a permanent or transient manner in combination with other genetic elements such as vectors, promoters, enhancers etc.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., Molecular Cloning: A Laboratory Manual, Cold Spring Harbor Press (1989); Maliga et al., Methods in Plant Molecular Biology, Cold Spring Harbor Press (1995); Birren et al., Genome Analysis: Detecting Genes, 1, Cold Spring Harbor, N.Y. (1998); Birren et al., Genome Analysis Analyzing DNA, 2, Cold Spring Harbor, N.Y. (1998); Plant Molecular Biology: A Laboratory Manual, eds. Clark, Springer, N.Y. (1997)).

The transgenic oilseeds of the invention can be processed to yield oil, protein products and/or by-products that are derivatives obtained by processing that have commercial value. One example, of many, useful for illustrating this point are transgenic soybean seeds of the invention which can be processed to yield soy oil, soy products and/or soy by-products.

"Soy products" can include, but are not limited to, those items listed in Table 1A.

TABLE 1A

Soy Protein Products Derived from Soybean Seeds[a]

Whole Soybean Products

Roasted Soybeans
Baked Soybeans
Soy Sprouts
Soy Milk
Specialty Soy Foods/Ingredients Soy Milk
Tofu
Tempeh
Miso
Soy Sauce
Hydrolyzed Vegetable Protein
Whipping Protein TABLE 1A-continued Soy Protein Products Derived from Soybean Seeds[a]

Processed Soy Protein Products

Full Fat and Defatted Flours
Soy Grits
Soy Hypocotyls
Soybean Meal
Soy Milk
Soy Protein Isolates
Soy Protein Concentrates
Textured Soy Proteins
Textured Flours and Concentrates
Textured Concentrates
Textured Isolates

[a]See Soy Protein Products: Characteristics, Nutritional Aspects and Utilization (1987). Soy Protein Council.

"Processing" refers to any physical and chemical methods used to obtain the products listed in Table 1A and includes, but is not limited to, heat conditioning, flaking and grinding, extrusion, solvent extraction, or aqueous soaking and extraction of whole or partial seeds. Furthermore, "processing" includes the methods used to concentrate and isolate soy protein from whole or partial seeds, as well as the various traditional Oriental methods in preparing fermented soy food products. Trading Standards and Specifications have been established for many of these products (see National Oilseed Processors Association Yearbook and Trading Rules 1991-1992). Products referred to as being "high protein" or "low protein" are those as described by these Standard Specifications. "NSI" refers to the Nitrogen Solubility Index as defined by the American Oil Chemists' Society Method Ac4 41. "KOH Nitrogen Solubility" is an indicator of soybean meal quality and refers to the amount of nitrogen soluble in 0.036 M KOH under the conditions as described by Araba and Dale [(1990) *Poult. Sci.* 69:76-83]. "White" flakes refer to flaked, dehulled cotyledons that have been defatted and treated with controlled moist heat to have an NSI of about 85 to 90. This term can also refer to a flour with a similar NSI that has been ground to pass through a No. 100 U.S. Standard Screen size. "Cooked" refers to a soy protein product, typically a flour, with an NSI of about 20 to 60. "Toasted" refers to a soy protein product, typically a flour, with an NSI below 20. "Grits" refer to defatted, dehulled cotyledons having a U.S. Standard screen size of between No. 10 and 80. "Soy Protein Concentrates" refer to those products produced from dehulled, defatted soybeans by three basic processes: acid leaching (at about pH 4.5), extraction with alcohol (about 55-80%), and denaturing the protein with moist heat prior to extraction with water. Conditions typically used to prepare soy protein concentrates have been described by Pass [(1975) U.S. Pat. No. 3,897,574; Campbell et al., (1985) in New Protein Foods, ed. by Altschul and Wilcke, Academic Press, Vol. 5, Chapter 10, *Seed Storage Proteins, pp* 302-338]. "Extrusion" refers to processes whereby material (grits, flour or concentrate) is passed through a jacketed auger using high pressures and temperatures as a means of altering the texture of the material. "Texturing" and "structuring" refer to extrusion processes used to modify the physical characteristics of the material. The characteristics of these processes, including thermoplastic extrusion, have been described previously [Atkinson (1970) U.S. Pat. No. 3,488,770, Horan (1985) In *New Protein Foods*, ed. by Altschul and Wilcke, Academic Press, Vol. 1A, Chapter 8, pp 367-414]. Moreover, conditions used during extrusion processing of complex foodstuff mixtures that include soy protein products have been described previously [Rokey (1983) *Feed Manufacturing Technology III*, 222-237; McCulloch, U.S. Pat. No. 4,454,804].

TABLE 1B

Generalized Steps for Soybean Oil and Byproduct Production

| Process Step | Process | Impurities Removed and/or By-Products Obtained |
|---|---|---|
| #1 | soybean seed | |
| #2 | oil extraction | meal |
| #3 | Degumming | lecithin |
| #4 | alkali or physical refining | gums, free fatty acids, pigments |
| #5 | water washing | soap |
| #6 | Bleaching | color, soap, metal |
| #7 | (hydrogenation) | |
| #8 | (winterization) | stearine |
| #9 | Deodorization | free fatty acids, tocopherols, sterols, volatiles |
| #10 | oil products | |

More specifically, soybean seeds are cleaned, tempered, dehulled, and flaked, thereby increasing the efficiency of oil extraction. Oil extraction is usually accomplished by solvent (e.g., hexane) extraction but can also be achieved by a combination of physical pressure and/or solvent extraction. The resulting oil is called crude oil. The crude oil may be degummed by hydrating phospholipids and other polar and neutral lipid complexes that facilitate their separation from the nonhydrating, triglyceride fraction (soybean oil). The resulting lecithin gums may be further processed to make commercially important lecithin products used in a variety of food and industrial products as emulsification and release (i.e., antisticking) agents. Degummed oil may be further refined for the removal of impurities (primarily free fatty acids, pigments and residual gums). Refining is accomplished by the addition of a caustic agent that reacts with free fatty acid to form soap and hydrates phosphatides and proteins in the crude oil. Water is used to wash out traces of soap formed during refining. The soapstock byproduct may be used directly in animal feeds or acidulated to recover the free fatty acids. Color is removed through adsorption with a bleaching earth that removes most of the chlorophyll and carotenoid compounds. The refined oil can be hydrogenated, thereby resulting in fats with various melting properties and textures. Winterization (fractionation) may be used to remove stearine from the hydrogenated oil through crystallization under carefully controlled cooling conditions. Deodorization (principally via steam distillation under vacuum) is the last step and is designed to remove compounds which impart odor or flavor to the oil. Other valuable byproducts such as tocopherols and sterols may be removed during the deodorization process. Deodorized distillate containing these byproducts may be sold for production of natural vitamin E and other high-value pharmaceutical products. Refined, bleached, (hydrogenated, fractionated) and deodorized oils and fats may be packaged and sold directly or further processed into more specialized products. A more detailed reference to soybean seed processing, soybean oil production, and byproduct utilization can be found in Erickson, Practical Handbook of Soybean Processing and Utilization, The American Oil Chemists' Society and United Soybean Board (1995). Soybean oil is liquid at room temperature because it is relatively low in saturated fatty acids when compared with oils such as coconut, palm, palm kernel, and cocoa butter.

Plant and microbial oils containing PUFAs that have been refined and/or purified can be hydrogenated, thereby resulting in fats with various melting properties and textures. Many processed fats (including spreads, confectionary fats, hard butters, margarines, baking shortenings, etc.) require varying degrees of solidity at room temperature and can only be produced through alteration of the source oil's physical properties. This is most commonly achieved through catalytic hydrogenation.

Hydrogenation is a chemical reaction in which hydrogen is added to the unsaturated fatty acid double bonds with the aid of a catalyst such as nickel. For example, high oleic soybean oil contains unsaturated oleic, linoleic, and linolenic fatty acids, and each of these can be hydrogenated. Hydrogenation has two primary effects. First, the oxidative stability of the oil is increased as a result of the reduction of the unsaturated fatty acid content. Second, the physical properties of the oil are changed because the fatty acid modifications increase the melting point resulting in a semi-liquid or solid fat at room temperature.

There are many variables which affect the hydrogenation reaction, which in turn alter the composition of the final product. Operating conditions including pressure, temperature, catalyst type and concentration, agitation, and reactor design are among the more important parameters that can be controlled. Selective hydrogenation conditions can be used to hydrogenate the more unsaturated fatty acids in preference to the less unsaturated ones. Very light or brush hydrogenation is often employed to increase stability of liquid oils. Further hydrogenation converts a liquid oil to a physically solid fat. The degree of hydrogenation depends on the desired performance and melting characteristics designed for the particular end product. Liquid shortenings (used in the manufacture of baking products, solid fats and shortenings used for commercial frying and roasting operations) and base stocks for margarine manufacture are among the myriad of possible oil and fat products achieved through hydrogenation. A more detailed description of hydrogenation and hydrogenated products can be found in Patterson, H. B. W., Hydrogenation of Fats and Oils: Theory and Practice. The American Oil Chemists' Society (1994).

Hydrogenated oils have become somewhat controversial due to the presence of trans-fatty acid isomers that result from the hydrogenation process. Ingestion of large amounts of trans-isomers has been linked with detrimental health effects including increased ratios of low density to high density lipoproteins in the blood plasma and increased risk of coronary heart disease.

In a further aspect, the present invention concerns an isolated polynucleotide comprising:

(a) a nucleotide sequence encoding a polypeptide having diacylglycerol acyltransferase activity wherein the polypeptide has at least 80% amino acid identity, based on the Clustal V method of alignment, when compared to an amino acid sequence as set forth in SEQ ID NOs: 135, 136, 147, 162, 176, 215, 234, 255, 265, 272, 299, 304, 306, 308, 310, 312, 314, 316, 318, or 320;

(b) a nucleotide sequence encoding a polypeptide having diacylglycerol acyltransferase activity, wherein the nucleotide sequence has at least 80% sequence identity, based on the BLASTN method of alignment, when compared to a nucleotide sequence as set forth in SEQ ID NO: 133, 134, 146, 161, 175, 214, 233, 264, 271, 298, 303, 305, 307, 309, 311, 313, 315, 317, 319, 350, or 362;

(c) a nucleotide sequence encoding a polypeptide having diacylglycerol acyltransferase activity, wherein the nucleotide sequence hybridizes under stringent conditions to a nucleotide sequence as set forth in SEQ ID NO: 133, 134, 146, 161, 175, 214, 233, 264, 271, 298, 303, 305, 307, 309, 311, 313, 315, 317, 319, 350, or 362; or (d) a complement of the nucleotide sequence of (a), (b) or (c), wherein the complement and the nucleotide sequence consist of the same number of nucleotides and are 100% complementary.

It a related aspect, the present invention concerns an isolated polynucleotide comprising:

(a) a nucleotide sequence encoding a polypeptide having diacylglycerol acyltransferase activity wherein the polypeptide is set forth in SEQ ID NOs:135, 136, 147, 162, 176, 215, 234, 255, 265, 272, 299, 304, 306, 308, 310, 312, 314, 316, 318, 320, 322, 351, or 363;

(b) a nucleotide sequence encoding a polypeptide having diacylglycerol acyltransferase activity, wherein the nucleotide sequence is set forth in SEQ ID NO: 133, 134, 146, 161, 175, 214, 233, 264, 271, 298, 303, 305, 307, 309, 311, 313, 315, 317, 319, 319, 350, or 362; or (c) a complement of the nucleotide sequence of (a) or (b) wherein the complement and the nucleotide sequence consist of the same number of nucleotides and are 100% complementary.

Further, the aforementioned isolated polynucleotide encoding a DGAT can be obtained from one or more oleaginous organism. These oleaginous organisms can be, but are not limited to, *Torulaspora delbrueckii*, *Pichia anomala*, *Debaryomyces hansenii*, *Candida zeylanoides*, *Lipomyces starkeyi*, *Mucor circinelloides*, *Phaffia rhodozyma*, *Rhodotorula glutinis*, *Cryptococcus curvatus*, and *Mortierella alpina*.

Recombinant DNA construct comprising the isolated nucleic acid fragment encoding diacylglycerol acyltransferase can be operably linked to at least one regulatory sequence, and can be incorporated into a cell. The cell may be from an oilseed plant.

In a related aspect the present invention concerns a method for increasing the total fatty acid content of an oilseed comprising:

(a) transforming at least one oilseed cell with the above mentioned recombinant construct;

(b) selecting the transformed oilseed cell(s) of step (a) having an increased total fatty acid content when compared to the total fatty acid content of a non-transgenic, null segregant oilseed.

In a final aspect the present invention concerns a fungal cell, or oleaginous microbial organism, comprising a recombinant DNA construct comprising any isolated nucleic acid fragment encoding any diacylglycerol acyltransferase of the present invention. Further, the fungal cell can be, but is not limited to, *Yarrowia*, *Candida*, *Rhodotorula*, *Rhodosporidium*, *Cryptococcus*, *Trichosporon* and *Lipomyces*.

EXAMPLES

The present invention is further defined in the following Examples, in which parts and percentages are by weight and degrees are Celsius, unless otherwise stated. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various usages and conditions. Thus, various modifications of the invention in addition to those shown and described herein will be apparent to those skilled in the art from the foregoing description. Such modifications are also intended to fall within the scope of the appended claims.

The meaning of abbreviations is as follows: "sec" means second(s), "min" means minute(s), "h" means hour(s), "d" means day(s), "μL" means microliter(s), "mL" means milliliter(s), "L" means liter(s), "μM" means micromolar, "mM" means millimolar, "M" means molar, "mmol" means millimole(s), "pmole" mean micromole(s), "g" means gram(s), "μg" means microgram(s), "ng" means nanogram(s), "U" means unit(s), "bp" means base pair(s) and "kB" means kilobase(s).

Example 1

Expression of *Yarrowia lipolytica* DGAT Genes in *Saccharomyces cerevisiae*

The DGAT1 gene (SEQ ID NO:1) of *Yarrowia lipolytica* was excised from plasmid vector pYDA1 (SEQ ID NO:2) by restriction digestion with NcoI and NotI. The ends of DNA fragment were completely filled in using T4 DNA polymerase (Promega, Madison, Wis., USA) and ligated into the unique Not I site of pY75 (SEQ ID NO:3). Prior to its use for cloning the pY75 vector had been linearized with NotI, filled in with T4 DNA polymerase and dephosphorylated with shrimp alkaline phosphatase (NEB, Beverly, Mass., USA). Plasmid DNA was isolated using standard techniques and restriction digests with EcoRI were conducted to identify plasmid clones in which the start codon was in proximity to the 3' end of the GPD promoter in pY75 (sense orientation of the DGAT1 gene). This plasmid is henceforth referred to as pY75 YL DGAT1 (SEQ ID NO:4). The construction of pYDA1 is described in PCT Publication No. WO 2006/052914, which is hereby incorporated as reference.

The yeast episomal plasmid (YEp)-type vector pRS425 (SEQ ID NO:5) (Christianson et al., *Gene* 110:119-122 (1992)) contains sequences from the *Saccharomyces cerevisiae* 2 micron endogenous plasmid, a LEU2 selectable marker and sequences based on the backbone of a multifunctional phagemid, pBluescript II SK(+). The *Saccharomyces cerevisiae* strong, constitutive glyceraldehyde-3-phosphate dehydrogenase (GPD) promoter was cloned between the SacII and SpeI sites of pRS425 in the same way as described by Jia et al. (*Physiol. Genomics* 3:83-92 (2000)) to produce pGPD-425 (SEQ ID NO:6). A NotI site was introduced into the BamHI site of pGPD-425, thus giving a NotI site flanked by BamHI sites, and this plasmid was called pY75 (SEQ ID NO:3)

The DGAT2 gene was PCR amplified from the genome of *Yarrowia lipolytica* (ATCC Accession No. 20362) as follows. Yeast cells were grown on solid YPD medium for 72h. Cells were resuspended in 200 μL of DNA extraction buffer (100 mM Tris pH 7.5, 10 mM EDTA, 100 mM NaCl, 0.1% Triton X-100) and supplemented with 2-5 glass beads (3 mm diameter) and approximately 0.1 g of glass beads (0.5 mm diameter). The yeast cell suspension was mixed vigorously using a vortex mixer and incubated at 75° C. for 25 min. The lysate was cooled to room temperature and cleared by centrifugation.

The following two oligonucleotide primers were used to generate a PCR fragment of approximately 1600 bp:

oYLDGAT2-1:
(SEQ ID NO: 7)
GCGGCCGCATGACTATCGACTCACAATACTACAAGT,
and oYLDGAT2-2:
(SEQ ID NO: 8)
GCGGCCGCTTACTCAATCATTCGGAACTCTGGGGCT.

Briefly, a PCR reaction mixture (100 μL) containing 2.5 mM MgCl$_2$, 2 mM dNTPs, 10 mM Tris/HCl (pH 8.8), 50 mM KCl, 0.08% Nonidet P40, 1 µM of oYLDGAT2-1 (SEQ ID NO:7) and oYLDGAT2-2 (SEQ ID NO:8), 10 U Taq polymerase (Fermentas, Hanover, Md.), and 2 µL of yeast lysate was created. The PCR mixture was divided into four 25 µL aliquots and amplification was carried out for 35 cycles, each comprising 45 sec at 94° C., 45 sec at the respective annealing temperature, and 1 min at 72° C. PCR products were gel-purified and cloned into PGEM T-easy (Promega) using manufacturer instructions.

Ten independent plasmid clones were completely sequenced. The consensus sequence of this analysis is set forth as SEQ ID NO:9. This DNA sequence differs from the DGAT2 sequence disclosed in PCT Publication No. WO 2005/003322 at two different nucleotide positions. The difference in DNA sequence affects nt 448 and nt 672 of the DGAT2 open reading frame. The former nt difference changes the predicted amino acid sequence of the DGAT protein. It replaces a serine found in the DGAT sequence disclosed in PCT Publication No. WO 2005/003322 with a threonine residue. The second sequence difference does not change the amino acid sequence from the one disclosed in PCT Publication No. WO 2005/003322. The difference between the Yarrowia lipolytica DGAT2 sequence disclosed herein and that of PCT Publication No. WO 2005/003322 can be attributed to the different Yarrowia lipolytica strains that were used for DGAT2 gene isolation. The predicted amino acid sequence of the DGAT protein of strain ATCC Accession No. 20362 is set forth as SEQ ID NO:10.

The DGAT gene (SEQ ID NO:9) was excised as a Not I restriction fragment from the PGEM T-easy vector and ligated to NotI linearized, dephosphorylated DNA of pY75 (SEQ ID NO:3). Plasmid DNA was isolated form recombinant clones and restriction digestion with SacI and PacI allowed to identify clones in which the start codon of the DGAT2 gene was in proximity to the 3' end of the GPD promoter in pY75 (sense orientation of the DGAT2 gene). This plasmid is henceforth referred to as pY75 YL DGAT2 (SEQ ID NO:11).

Plasmid DNA of pY75 YL DGAT1 (SEQ ID NO:4) and the empty pY75 vector were transformed into the Saccharomyces cerevisiae stain INVSC1 (Invitrogen, USA) using standard methods (Gietz, R. Daniel; Woods, Robin A., Meth. Enzymol. 350:87-96 (2002)). Recombinant yeast colonies were selected on DOBA media supplemented with CSM-leu (Qbiogene, Carlsbad, Calif.). Five 50 mL cultures of DOBA media supplemented with CSM-leu were inoculated with five independently generated colonies and grown and 30° C. for 72 h. Cells were harvested by centrifugation and resuspended in medium identical to the DOBA medium described above with the exception that ammonium sulfate as nitrogen source was omitted. Cultures were grown for additional 60 h, cells were harvested by centrifugation. Cells were frozen on dry ice and lyophilized.

Total fatty acid content of each yeast cell sample was measured in triplicates as follows. Approximately 5-15 mg of yeast powder were weighed into the bottom of a 13×100 mm glass culture tube with screw cap and Teflon seal. 5 µL of a stock solution of 17:0 TAG (10 mg/mL in toluene) was added followed by addition of 500 µL 5% sulfuric acid in methanol (anhydrous). Samples were incubated at 95° C. for 1.5 h. Subsequently, tubes were allowed to cool to room temperature after which 1 mL of 1 M sodium chloride was added followed by mixing. 1 mL of heptane was added, contents were mixed and samples were spun briefly to mediate phase separation. Approximately 500 µL of the organic phase was transferred to a GC vial. Fatty acid methyl esters were analyzed by gas chromatography. 4 µL of heptane extract were analyzed on Hewlett-Packard 6890 Gas Chromatograph fitted with an Omegawax 320 fused silica capillary column (Supelco Inc., Catalog No. 24152). The oven temperature was programmed to hold at 220° C. for 2.7 min, increase to 240° C. at 20 C /min and then hold for an additional 2.3 min. Carrier gas was supplied by a Whatman hydrogen generator. Retention times were compared to those for methyl esters of standards commercially available (Nu-Chek Prep, Inc. catalog #U-99-A).

Plasmid DNA of pY75 YL DGAT2 (SEQ ID NO:11) and the empty pY75 vector were transformed into the Saccharomyces cerevisiae strain INVSC1 and total fatty acid content of recombinant yeast cultures was analyzed as described previously. The findings related to over expression of both DGAT genes in yeast are summarized in TABLE 2.

TABLE 2

| | Total Fatty Acid Content of Saccharomyces cerevisea Cultures | | | | | | | |
|---|---|---|---|---|---|---|---|---|
| | % palmitic acid | % palmitoleic acid | % stearic acid | % oleic acid | FAME (% DCW) | stdv | average FAME (% DCW) | stdv FAME (% DCW) |
| pY75 YL DGAT1 | 19.1 | 38.4 | 7.5 | 34.9 | 12.8 | 2.2 | 11.9 | 0.8 |
| | 19.4 | 38.8 | 7.4 | 34.3 | 12.3 | 0.4 | | |
| | 19.2 | 38.4 | 7.6 | 34.8 | 12.2 | 0.4 | | |
| | 19.3 | 38.6 | 7.5 | 34.6 | 11.5 | 0.1 | | |
| | 19.1 | 38.3 | 7.7 | 34.9 | 10.9 | 0.6 | | |
| pY75 | 17.9 | 37.8 | 7.9 | 36.4 | 10.7 | 1.0 | 9.3 | 0.9 |
| | 18.2 | 38.2 | 7.8 | 35.8 | 9.7 | 0.6 | | |
| | 17.9 | 41.0 | 6.8 | 34.2 | 8.7 | 0.3 | | |
| | 17.2 | 40.5 | 6.9 | 35.4 | 8.7 | 0.6 | | |
| | 18.1 | 41.1 | 6.9 | 33.9 | 8.5 | 0.2 | | |
| pY75 YL DGAT2 | 31.8 | 34.0 | 14.2 | 20.0 | 17.1 | 0.2 | 14.2 | 2.3 |
| | 31.4 | 33.1 | 14.8 | 20.6 | 15.9 | 0.6 | | |
| | 30.7 | 32.8 | 14.7 | 21.8 | 13.6 | 1.1 | | |
| | 28.9 | 34.2 | 13.5 | 23.5 | 12.4 | 1.4 | | |
| | 29.2 | 34.1 | 13.5 | 23.1 | 11.8 | 1.7 | | |
| pY75 | 19.7 | 37.0 | 9.6 | 33.7 | 7.0 | 0.4 | 6.6 | 0.2 |
| | 20.0 | 36.4 | 9.8 | 33.7 | 6.8 | 0.0 | | |
| | 19.6 | 37.0 | 9.6 | 33.8 | 6.6 | 0.6 | | |
| | 19.7 | 37.1 | 9.5 | 33.6 | 6.4 | 0.2 | | |
| | 19.3 | 36.9 | 9.7 | 34.1 | 6.4 | 0.3 | | |

TABLE 2 shows that there is a significant increase of total fatty acids in yeast cells harboring the pY75 YL DGAT1 (SEQ ID NO:4) compared to cells that only contain the empty pY75 plasmid. The average fatty acid dry cell weigt (DCW) percentage of five independent cultures is 11.9% compared to 9.3% for vector controls grown under identical conditions. In summary, there is a 28% increase in total fatty acid production. Moreover, there is a slight alteration in the fatty acid profile associated with YL DGAT1 expression characterized by an increase in palmitic acid.

Constitutive expression of YL DGAT2 under nitrogen starvation increased total fatty acid content by 110% compared to a vector control grown under identical conditions. Total fatty acid content of the vector only control was 6.6% whereas the average fatty acid content of the YL DGAT2 transformants was 14.2%. The fatty acid profile changed as result of YL DGAT2 expression. Palmitic acid content increased significantly accompanied by a moderate decrease in palmitoleic. In addition, stearic acid content increased significantly accompanied by a clear decrease in oleic content. Taken together the results show that YL DGATs over-expression in yeast under conditions of increased carbon/nitrogen ratios lead to increased fatty acid accumulation. The overexpressed YL DGAT enzymes are able to augment endogenous DGAT activity in *Saccharomyces cerevisiae*. Similar experiments were repeated with both DGAT genes two more times. A difference in fatty acid content between YL DGAT culture and vector control could be observed every time and was at least 8% and 14.3% for YL DGAT1 (SEQ ID NO:1) and YL DGAT2 (SEQ ID NO:9), respectively.

Example 2

Cloning the *Yarrowia lipolytica* DGAT1 And DGAT2 into *Yarrowia lipolytica* Expression Vectors The present Example describes the generation of pFBAIN-YDG1 and pFBAIN-YDG2, comprising a chimeric FBAINm::YDGAT1::PEX20 gene and a chimeric FBAINm::YDGAT2::PEX20 gene, respectively (FIGS. 1A and 1B). These were designed for overexpression of the DGAT1 and DGAT2 in *Yarrowia lipolytica*.

Oligonucleotides YDGAT1-F (SEQ ID NO:12) and YDGAT-R (SEQ ID NO:13) were designed and synthesized to allow amplification of the DGAT1ORF from *Yarrowia lipolytica* genomic DNA (isolated from strain ATCC Accession No. 20362, purchased from the American Type Culture Collection (Rockville, Md.)), while oligonucleotides YDGAT2-F (SEQ ID NO:14) and YDGAT2-R (SEQ ID NO:15) were designed and synthesized to allow the amplification of the DGAT2 ORF.

The PCR reactions, with *Yarrowia lipolytica* genomic DNA as template, were individually carried out in a 50 μL total volume comprising: 1 μL each of 20 μM forward and reverse primers, 1 μL genomic DNA (100 ng), 10 μL 5×PCR buffer, 1 μL dNTP mix (10 μM each), 35 μL water and 1 μL Phusion polymerase (New England Biolabs, Inc., Ipswich, Mass.). Amplification was carried out at 98° C. for 1 min, followed by 30 cycles at 98° C. for 10 sec, 55° C. for 10 sec, and 72° C. for 30 sec, followed by a final elongation cycle at 72° C. for 5 min. A 1603 bp DNA fragment (SEQ ID NO:16) and a 1567 bp fragment (SEQ ID NO:17) were generated that contained the DGAT1 and DGAT2 ORFs, respectively.

The PCR fragments were purified with Qiagen PCR purification kits following the manufacturer's protocol. Purified DNA samples were digested with NcoI and NotI, purified with a Qiagen reaction clean-up kit, and then directionally ligated with NcoI/NotI digested pFBAIN-MOD-1 (FIG. 1C; SEQ ID NO:18). Specifically, the ligation reaction contained: 10 μL 2× ligation buffer, 1 μL T4 DNA ligase (Promega), 4 μL (~300 ng) of either the 1600 bp fragment (i.e., DGAT1; SEQ ID NO:16) or the 1564 bp fragment (i.e., DGAT2; SEQ ID NO:17) and 1 μL pFBAIN-MOD-1 (~150 ng). The reaction mixtures were incubated at room temperature for 2 h and used to transform *E. coli* Top10 competent cells (Invitrogen). Plasmid DNA from transformants was recovered using a Qiagen Miniprep kit. Correct clones were identified by restriction mapping and the final constructs were designated "PFBAIN-YDG1" and "pFBAIN-YDG2", respectively.

Thus, pFBAIN-YDG1 (FIG. 1A; SEQ ID NO:19) thereby contained the following components:

TABLE 3

| Components of Plasmid pFBAIN-YDG1 (SEQ ID NO: 19) | |
|---|---|
| RE Sites And Nucleotides Within SEQ ID NO: 19 | Description of Fragment and Chimeric Gene Components |
| BglII-BsiWI (6040-301) | FBAINm::YDG1::PEX20, comprising: FBAINm: *Yarrowia lipolytica* FBAINm promoter (PCT Publication No. WO 2005/049805) YDG1: Y. lipolytica DGAT1 ORF (SEQ ID NO: 16) Pex20: Pex20 terminator sequence of *Yarrowia* Pex20 gene (GenBank Accession No. AF054613) |
| PacI-BglII (4533-6040) | *Yarrowia* URA3 (GenBank Accession No. AJ306421) |
| (3123-4487) | *Yarrowia* autonomous replicating sequence 18 (ARS18; GenBank Accession No. M91600 and No. A17608) |
| (2464-2864) | f1 origin |
| (1424-2284) | ampicillin-resistance gene (Amp$^R$) for selection in *E. coli* |
| (474-1354) | ColE1 plasmid origin of replication |

Plasmid pFBAIN-YDG2 (FIG. 1B; SEQ ID NO:20) contained components identical to those of pFBAIN-YDG1, with the exception that the *Yarrowia lipolytica* DGAT2 ORF (SEQ ID NO:17; identified as YDG2 on FIG. 1B) was present instead of the *Yarrowia lipolytica* DGAT1ORF in pFBAIN-YDG1.

The term "FBAINm promoter" or "FBAINm promoter region" is a modified version of the FBAIN promoter (infra), wherein FBAINm has a 52 bp deletion between the ATG translation initiation codon and the intron of the FBAIN promoter (thereby including only 22 amino acids of the N-terminus) and a new translation consensus motif after the intron. Furthermore, while the FBAIN promoter generates a fusion protein when fused with the coding region of a gene to be expressed, the FBAINm promoter does not generate such a fusion protein. The FBAIN promoter refers to the 5' upstream untranslated region in front of the 'ATG' translation initiation codon of the *Yarrowia lipolytica* fructose-bisphosphate aldolase enzyme (E.C. 4.1.2.13) encoded by the fba1 gene and that is necessary for expression, plus a portion of 5' coding region that has an intron of the fba1 gene. These promoters are described in detail in PCT Publication No. WO 2005/049805 and U.S. Pat. No. 7,202,356, which are hereby incorporated by reference in their entirety.

Example 3

Overexpression of *Yarrowia lipolytica* DGAT1 And DGAT2 Genes in *Yarrowia lipolytica* Strain Y2224

The present Example describes increased fatty acid content, and modification to the relative abundance of each fatty acid species, in *Yarrowia lipolytica* strain Y2224 that was transformed to co-express either the *Yarrowia lipolytica* DGAT1 (SEQ ID NO:16) or the *Yarrowia lipolytica* DGAT2 (SEQ ID NO:17). Strain Y2224 is a FOA resistant mutant from an autonomous mutation of the Ura3 gene of wild type *Yarrowia* strain ATCC Accession No. 20362.

Generation Of Strain Y2224: Strain Y2224 was isolated in the following manner: *Yarrowia lipolytica* ATCC Accession No. 20362 cells from a YPD agar plate (1% yeast extract, 2% bactopeptone, 2% glucose, 2% agar) were streaked onto a minimal media plate (75 mg/L each of uracil and uridine, 6.7 g/L YNB with ammonia sulfate, without amino acid, and 20 g/L glucose) containing 250 mg/L 5-FOA (5-fluorouracil-6-carboxylic acid monohydrate; Zymo Research). Plates were incubated at 28° C. and four of the resulting colonies were patched separately onto minimal media (MM) plates containing 200 mg/mL 5-FOA and MM plates lacking uracil and uridine to confirm uracil Ura3 auxotrophy.

Transformation of Strain Y2224: A clone of pFBAIn-YDG1, a clone of pFBAIn-YDG2 and control plasmid pFBAIN-MOD-1 were transformed into *Yarrowia lipolytica* strain Y2224 as described below.

Transformation of *Yarrowia lipolytica* was performed according to the method of Chen, D. C. et al. (*Appl. Microbiol. Biotechnol.* 48(2):232-235 (1997)), unless otherwise noted. Briefly, *Yarrowia* was streaked onto a YPD agar plate and grown at 30° C. for approximately 18 h. Several large loopfuls of cells were scraped from the plate and resuspended in 1 mL of transformation buffer containing: 2.25 mL of 50% PEG, average MW 3350; 0.125 mL of 2 M lithium acetate, pH 6.0; 0.125 mL of 2 M DTT; and 50 µg sheared salmon sperm DNA. Then, approximately 500 ng of linearized plasmid DNA was incubated in 100 µL of resuspended cells, and maintained at 39° C. for 1 h with vortex mixing at 15 min intervals.

The cells from each transformation were plated onto minimal media (MM) plates lacking uracil (0.17% yeast nitrogen base (DIFCO Laboratories, Detroit, Mich.) without ammonium sulfate or amino acids, 2% glucose, 0.1% proline, pH 6.1, 20 g/L agar) and maintained at 30° C. for 2 days. Three transformants from each transformation plate were used to inoculate individual 25 mL culture in MM medium (0.17% yeast nitrogen base (DIFCO Laboratories) without ammonium sulfate or amino acids, 2% glucose, 0.1% proline, pH 6.1). Each culture was allowed to grow for 2 days at 30° C., then switched into 25 mL of high glucose medium ("HG medium", comprising 80 g/L glucose, 27 g/L $K_2HPO_4$, 6.3 g/L $KH_2PO_4$, pH ~7.5) and allowed to grow for 5 days at 30° C.

Lipid Analysis: Total lipids were extracted, and fatty acid methyl esters (FAMEs) were prepared by trans-esterification, and subsequently analyzed with a Hewlett-Packard 6890 GC.

More specifically, for fatty acid analysis, cells were collected by centrifugation and lipids were extracted as described in Bligh, E. G. & Dyer, W. J. (*Can. J. Biochem. Physiol.* 37:911-917 (1959)). Fatty acid methyl esters were prepared by transesterification of the lipid extract with sodium methoxide (Roughan, G. and Nishida I., *Arch Biochem Biophys.* 276(1):38-46 (1990)) and subsequently analyzed with a Hewlett-Packard 6890 GC fitted with a 30-m× 0.25 mm (i.d.) HP—INNOWAX (Hewlett-Packard) column. The oven temperature was from 170° C. (25 min hold) to 185° C. at 3.5° C./min.

For direct base transesterification, *Yarrowia* culture (3 mL) was harvested, washed once in distilled water, and dried under vacuum in a Speed-Vac for 5-10 min. Sodium methoxide (100 µL of 1%) was added to the sample, and then the sample was vortexed and rocked for 20 min. After adding 3 drops of 1 M NaCl and 400 µL hexane, the sample was vortexed and spun. The upper layer was removed and analyzed by GC as described above.

Based on the above analyses, lipid content and composition was determined in transformant strains of Y2224, comprising pFBAIn-YDG1, pFBAIn-YDG2 and pFBAIN-MOD-1 (control), respectively, as shown below in TABLE 4. Three independent transformants of each strain were analyzed, while the average results are shown in the rows highlighted in grey. Fatty acids are identified as 16:0 (palmitate), 16:1 (palmitoleic acid), 18:0, 18:1 (oleic acid) and 18:2 (LA); and the composition of each is presented as a % of the total fatty acids.

"% FAME/DCW" represents the percent fatty acid methyl ester/dry cell weight. Dry cell weight was determined by collecting cells from 10 mL of culture via centrifugation, washing the cells with water once to remove residue medium, drying the cells in a vacuum oven at 80° C. overnight, and weighing the dried cells. The total amount of fatty acid methyl esters in a sample was determined by comparing the areas of all peaks in the GC profile with the peak area of an added known amount of internal standard C15:0 fatty acid.

TABLE 4

Lipid Content A\and Composition in *Yarrowia* Strain Y2224 Overexpressing YDGAT1 And YDGAT2

| Sample | Plasmid | % FAME/ DCW | 16:0 | 16:1 | 18:0 | 18:1 | 18:2 |
|---|---|---|---|---|---|---|---|
| 1 | pFBAIn-MOD-1 | 21.91 | 15.96 | 16.41 | 6.01 | 40.28 | 18.36 |
| 2 | pFBAIn-MOD-1 | 23.98 | 16.72 | 15.90 | 5.97 | 39.64 | 18.21 |
| 3 | pFBAIn-MOD-1 | 18.27 | 14.42 | 15.74 | 5.59 | 41.07 | 19.89 |
| Avg. 1-3 | Avg. pFBAIn-MOD-1 | 21.39 | 15.70 | 16.02 | 5.86 | 40.33 | 18.82 |
| 4 | pFBAIn-YDG1 | 22.50 | 15.76 | 16.74 | 5.95 | 40.72 | 17.79 |
| 5 | pFBAIn-YDG1 | 24.38 | 14.76 | 18.86 | 4.60 | 43.90 | 15.89 |
| 6 | pFBAIn-YDG1 | 24.22 | 15.20 | 18.42 | 4.66 | 43.20 | 16.1 |
| Avg. 4-6 | Avg. pFBAIn-YDG1 | 23.70 | 15.24 | 18.01 | 5.97 | 42.61 | 16.59 |
| 7 | pFBAIn-YDG2 | 23.51 | 13.56 | 13.55 | 7.70 | 46.20 | 16.45 |
| 8 | pFBAIn-YDG2 | 29.30 | 15.10 | 12.87 | 8.00 | 45.49 | 15.24 |
| 9 | pFBAIn-YDG2 | 29.15 | 14.57 | 13.74 | 8.44 | 47.00 | 13.79 |
| Avg. 7-9 | Avg. pFBAIn-YDG2 | 27.32 | 14.41 | 13.38 | 8.05 | 46.23 | 15.16 |

GC analyses showed that there was a significant increase of total fatty acids in cells carrying pFBAIn-YDG1, as compared to cells carrying pFBAIn-MOD-1. The average fatty acid increased from 21.39% FAME/DCW in the control to 23.70% FAME/DCW in cells expressing YDGAT1 (i.e., a 10.8% increase). Furthermore, there was also an increase in the amount of C16:1 and C18:1 fatty acids and a decrease of C18:2 fatty acid (TABLE 4).

Cells carrying pFBAIn-YDG2 also had a large increase in total fatty acid content relative to the control, resulting in an average of 27.32% FAME/DCW (representing an increase of 27.7%). The distribution of fatty acid species also changed significantly. Specifically, the amount of C18:0 and C18:1 was increased, whereas the amount of C16:0, C16:1 and C18:2 decreased.

Collectively, these results demonstrate that overexpression of the *Yarrowia lipolytica* DGAT1 or DGAT2 impacts both total lipid content and the relative abundance of each fatty acid species.

Example 4

Expression of *Yarrowia lipolytica* DGAT Genes in *Arabidopsis* Seed

A binary vector suitable for *agrobacterium*-mediated transformation was generated as follows. Various restriction sites were added, through a number of cloning steps, to the ends of the Bcon/NotI/Phas3' cassette from KS123 (SEQ ID NO:21), which was previously described in PCT Publication No. WO 02/008269 (the contents of which are hereby incorporated by reference). Briefly, a DNA fragment (cal a24-4; SEQ ID NO:22) was amplified from plasmid CalFad2-2 (described in PCT Publication No. WO 01/12800) using primers oCal-15 (SEQ ID NO:23) and oCal-6 (SEQ ID NO:24). DNA fragment cal a24-4 (SEQ ID NO:22) was digested with BglII and BamHI and cloned into the BamHI site of pKS123 to give pKR53B (SEQ ID NO:25). The XbaI/SbfI fragment of pKR53B, containing the Bcon/NotI/Phas3' cassette was cloned into the XbaI/SbfI fragment of pKR72 (ATCC Accession No. PTA-6019; SEQ ID NO:26) containing the bacterial hygromycin phosphotransferase gene, to give pKR85 (SEQ ID NO:27). The features of pKR72 are as follows. A starting plasmid pKR72 (ATCC Accession No. PTA-6019; SEQ ID NO:26), a derivative of pKS123 which was previously described in PCT Publication No. WO 02/008269 (the contents of which are hereby incorporated by reference), contains the hygromycin B phosphotransferase gene (HPT) (Gritz, L. and Davies, J., *Gene* 25:179-188 (1983)), flanked by the T7 promoter and transcription terminator (T7prom/hpt/T7term cassette), and a bacterial origin of replication (ori) for selection and replication in bacteria (e.g., *E. coli*). In addition, pKR72 also contains the hygromycin B phosphotransferase gene, flanked by the 35S promoter (Odell et al., *Nature* 313: 810-812 (1985)) and NOS 3' transcription terminator (Depicker et al., *J. Mol. Appl. Genet.* 1:561-570 (1982)) (35S/hpt/NOS3' cassette) for selection in plants such as soybean. pKR72 also contains a NotI restriction site, flanked by the promoter for the α' subunit of β-conglycinin (Beachy et al., *EMBO J.* 4:3047-3053 (1985)) and the 3' transcription termination region of the phaseolin gene (Doyle et al., *J. Biol. Chem.* 261:9228-9238 (1986)), thus allowing for strong tissue-specific expression in the seeds of soybean of genes cloned into the NotI site.

The Bcon/NotI/Phas3' cassette was amplified from plasmid pKR85 (SEQ ID NO:27) using primers oKR85-1 (SEQ ID NO:28) and oKR85-2 (SEQ ID NO:29) and the resulting DNA fragment was cloned into PCR-Script® (Stratgene) following the manufacture's protocol, to give pPCR85 (SEQ ID NO:30).

The EcoRI/BglII fragment of pPCR85, containing the Bcon/NotI/Phas3' cassette was cloned into the EcoRI/BamHI fragment of plasmid pZS199 (PCT Publication No. WO 93/11245; also U.S. Pat. No. 5,952,544 which was published on Jun. 10, 1993; the disclosures of which are hereby incorporated by reference), containing the *Arabidopsis* binary vector backbone to produce pKR91 (SEQ ID NO:31).

The Bcon/NotI/Phas3' cassette was removed from pKR91 by digestion with AscI and the re-ligated binary vector containing a unique AscI cloning site was produced called pKR92 (SEQ ID NO:32).

Construction of IKR92 YL DGAT2:

The construction of expression plasmid KS362 is described in Example 5. An expression cassette which harbors the YL DGAT2 gene, fused to betaconglycinin promoter and the phaseolin terminator and DsRed gene fused to Kti promoter and terminator sequences was excised from KS362 as a 6.4 kb AscI fragment. This DNA was ligated to AscI linearized, dephosphorylated pKR92 vector DNA to give pKR92 YL DGAT2 (SEQ ID NO:33).

Construction of pKR92 YL DGAT1/YL DGAT2:

The construction of expression plasmid KS364 is described in Example 5. An expression cassette in which YL DGAT1 (SEQ ID NO:1) and YL DGAT2 (SEQ ID NO:9) genes are fused to identical sequence of the phaseolin terminator and to glycinin 1 and betaconglycinin promoters respectively was excised from KS364 as a 7 kb AscI fragment. This DNA was ligated to AscI linearized, dephosphorylated pKR92 vector DNA to give pKR92 YL DGAT1/YL DGAT2 (SEQ ID NO:34)

Generation and Analysis of Transgenic Arabidospis Lines:

Plasmid DNA of pKR92 YL DGAT2 and pKR92 YL DGAT1/YL DGAT2 was introduced into *Agrobacterium tumefaciens* NTL4 (Luo et al, *Molecular Plant-Microbe Interactions* 14(1):98-103 (2001)) by electroporation. Briefly, 1 μg plasmid DNA was mixed with 100 μL of electrocompetent cells on ice. The cell suspension was transferred to a 100 μL electro oration curette (1 mm gap width) and electro orated using a BIORAD electro orator set to 1 kV, 400Ω and 25 μF. Cells were transferred to 1 mL LB medium and incubated for 2 h at 30° C. Cells were plated onto LB medium containing 50 μg/mL kanamycin. Plates were incubated at 30° C. for 60 h. Recombinant *agrobacterium* cultures (500 mL LB, 50 μg/mL kanamycin) were inoculated from single colonies of transformed *agrobacterium* cells and grown at 30° C. for 60 h. Cells were harvested by centrifugation (5000×g, 10 min) and resuspended in 1 L of 5% (W/V) sucrose containing 0.05% (VN) Silwet. *Arabidopsis* plants were grown in soil at a density of 30 plants per 100 cm² pot in metromix 360 soil mixture for 4 weeks (22° C., permanent light, 100 pE m$^{-2}$s$^{-1}$). Plants were repeatedly dipped into the *agrobacterium* suspension harboring the binary vectors and kept in a dark, high humidity environment for 24 h. Plants were grown for four to five weeks under standard plant growth conditions described above and plant material was harvested and dried for one week at ambient temperatures in paper bags. Seeds were harvested using a 0.425 mm mesh brass sieve.

Cleaned *Arabidopsis* seeds (2 g, corresponding to about 100,000 seeds) were sterilized by washes in 45 mL of 80% ethanol, 0.01% triton X-100, followed by 45 mL of 30% (V/V) household bleach in water, 0.01% triton X-100 and finally by repeated rinsing in sterile water. Aliquots of 20,000 seeds were transferred to square plates (20×20 cm) containing 150 mL of sterile plant growth medium comprised of 0.5×MS salts, 1.0% (W/V) sucrose, 0.05 MES/KOH (pH 5.8), 200 μg/mL timentin, and 50 μg/mL kanamycin solidified with 10 g/L agar. Homogeneous dispersion of the seed on the medium was facilitated by mixing the aqueous seed suspension with an equal volume of melted plant growth medium. Plates were incubated under standard growth conditions for ten days. Kanamycin-resistant seedlings were transferred to plant growth medium without selective agent and grown to maturity for 8-10 weeks (22° C., permanent light dark, 100-200 μE m$^{-2}$s$^{-1}$). Plants were grown in flats with 36 inserts. In every flat at least six untransformed wild type control plants were grown next to approximately thirty T2 plants. Seeds were harvested from individual plants and seed oil content was measured by NMR.

NMR Based Analysis of Seed Oil Content:

Seed oil content was determined using a Maran Ultra NMR analyzer (Resonance Instruments Ltd, Whitney, Oxfordshire, UK). Samples (either individual soybean seed or batches of *Arabidopsis* seed ranging in weight between 5 and 200 mg)

were placed into pre-weighed 2 mL polypropylene tubes (Corning Inc, Corning N.Y., USA; Part no. 430917) previously labeled with unique bar code identifiers. Samples were then placed into 96 place carriers and processed through the following series of steps by an Adept Cobra 600 SCARA robotic system.
1. pick up tube (the robotic arm was fitted with a vacuum pickup devise)
2. read bar code
3. expose tube to antistatic device (ensured that *Arabidopsis* seed were not adhering to the tube walls)
4. weigh tube (containing the sample), to 0.0001 g precision.
5. NMR reading; measured as the intensity of the proton spin echo 1 msec after a 22.95 MHz signal had been applied to the sample (data was collected for 32 NMR scans per sample)
6. return tube to rack
7. repeat process with next tube Bar codes, tubes weights and NMR readings were recorded by a computer connected to the system. Sample weight was determined by subtracting the polypropylene tube weight from the weight of the tube containing the sample.

Seed oil content of soybeans seed was calculated as follows:

$$\% \text{ oil } (\% \text{ wt basis}) = \frac{(NMR \text{ signal/sample wt }(g)) - 70.58}{351.45}$$

Calibration parameters were determined by precisely weighing samples of soy oil (ranging from 0.0050 to 0.0700 g at approximately 0.0050 g intervals; weighed to a precision of 0.0001 g) into Corning tubes (see above) and subjecting them to NMR analysis. A calibration curve of oil content (% seed wt basis; assuming a standard seed weight of 0.1500 g) to NMR value was established.

The relationship between seed oil contents measured by NMR and absolute oil contents measured by classical analytical chemistry methods was determined as follows. Fifty soybean seed, chosen to have a range of oil contents, were dried at 40° C. in a forced air oven for 48 h. Individual seeds were subjected to NMR analysis, as described above, and were then ground to a fine powder in a GenoGrinder (SPEX Centriprep (Metuchen, N.J., U.S.A.); 1500 oscillations per minute, for 1 minute). Aliquots of between 70 and 100 mg were weighed (to 0.0001 g precision) into 13×100 mm glass tubes fitted with Teflon® lined screw caps; the remainder of the powder from each bean was used to determine moisture content, by weight difference after 18 h in a forced air oven at 105° C. Heptane (3 mL) was added to the powders in the tubes and after vortex mixing samples were extracted, on an end-over-end agitator, for 1 h at room temperature. The extracts were centrifuged, 1500×g for 10 min, the supernatant decanted into a clean tube and the pellets were extracted two more times (1 h each) with 1 mL heptane. The supernatants from the three extractions were combined and 50 μL internal standard (triheptadecanoic acid; 10 mg/mL toluene) was added prior to evaporation to dryness at room temperature under a stream of nitrogen gas; standards containing 0, 0.0050, 0.0100, 0.0150, 0.0200 and 0.0300 g soybean oil, in 5 mL heptane, were prepared in the same manner. Fats were converted to fatty acid methyl esters (FAMEs) by adding 1 mL 5% sulfuric acid (v:v. in anhydrous methanol) to the dried pellets and heating them at 80° C. for 30 min, with occasional vortex mixing. The samples were allowed to cool to room temperature and 1 mL 25% aqueous sodium chloride was added followed by 0.8 mL heptane. After vortex mixing the phases were allowed to separate and the upper organic phase was transferred to a sample vial and subjected to GC analysis.

Plotting NMR determined oil contents versus GC determined oil contents resulted in a linear relationship between 9.66 and 26.27% oil (GC values; % seed wt basis) with a slope of 1.0225 and an $R^2$ of 0.9744; based on a seed moisture content that averaged 2.6+/−0.8%.

Seed oil content of *arabidopsis* seed was calculated as follows:

mg oil=(*NMR* signal−2.1112)/37.514

% oil (% wt basis)=(mg oil/1000)/sample weight)* 100

Prior to establishing this formula, *Arabidopsis* seed oil was extracted as follows. Approximately 5 g of mature *Arabidopsis* seed (cv Columbia) were ground to a fine powder using a mortar and pestle. The powder was placed into a 33×94 mm paper thimble (Ahlstrom # 7100-3394; Ahlstrom, Mount Holly Springs, Pa., USA) and the oil extracted during approximately 40 extraction cycles with petroleum ether (BP 39.9-51.7° C.) in a Soxhlet apparatus. The extract was allowed to cool and the crude oil was recovered by removing the solvent under vacuum in a rotary evaporator. Calibration parameters were determined by precisely weighing 11 standard samples of partially purified *Arabidopsis* oil (samples contained 3.6, 6.3, 7.9, 9.6 , 12.8, 16.3, 20.3, 28.2, 32.1, 39.9 and 60 mg of partially purified *Arabidopsis* oil) weighed to a precision of 0.0001 g) into 2 mL polypropylene tubes (Corning Inc, Corning N.Y., USA; Part no. 430917) and subjecting them to NMR analysis. A calibration curve of oil content (% seed wt basis) to NMR value was established.

Seed for pKR92 YL DGAT2 T2 were grown from a total of 293 independent events alongside 75 wild type controls. Oil content of YL DGAT2 transgenics ranged from 27.9-47.3%. Average oil content was 43.7%. Oil content of wild type controls ranged from 39.5-49.6%. Average oil content of wt controls was 44.8%.

Seed for pKR92 YL DGAT1/YL DGAT2 T2 were grown from a total of 295 independent events alongside 77 wild type controls. Oil content of YL DGAT1/YL DGAT2 transgenics ranged from 34.5-47.6%. Average oil content was 44%. Oil content of wild type controls ranged from 41.3-46.6%. Average oil content of wild type controls was 45%. In summary, these findings suggest that seed-specific expression of YL DGAT gene does not increase oil content of *arabidopsis* seed. Analysis of the Fatty Acid Profile of *Arabdidopsis* Seed Expressing YL DGAT2 Alone or in Combination with YL DGAT1:

GC analysis of FAME was employed to investigate if YL DGAT expression alters the fatty acid profile of *arabidopsis* seed. Approximately 100 F2 seed were dispensed into individual wells of 96 well strip tubes. For transesterification, 50 μL of trimethylsulfonium hydroxide (TMSH) and 0.5 mL of hexane were added to the each strip tube and incubated for 30 min at room temperature while shaking. Fatty acid methyl esters (1 μL injected from hexane layer) were separated and quantified using a Hewlett-Packard 6890 Gas Chromatograph fitted with an Omegawax 320 fused silica capillary column (Catalog #24152, Supelco Inc.). The oven temperature was programmed to hold at 220° C. for 2.6 min, increase to 240° C. at 20° C./min and then hold for an additional 2.4 min. Carrier gas was supplied by a Whatman hydrogen generator. Retention times were compared to those for methyl esters of standards commercially available (Nu-Chek Prep, Inc.). Results are summarized in TABLE 5.

TABLE 5

| | avg % oleic | range % oleic |
|---|---|---|
| pKR92 YL DGAT1/YL DGAT2 (n = 28) | 18.7 | 15.2-22.3 |
| wild type control (n = 8) | 15.2 | 14.5-15.6 |
| pKR92 YL DGAT2 (n = 26) | 16.4 | 14.9-18.4 |
| wild type control (n = 7) | 15.7 | 15.6-16 |

Results clearly demonstrate that expression of YL DAGT2 and even more so co-expression of YL DGAT1 and YL DGAT2 in *Arabidopsis* seed leads to increased incorporation of oleic acid into seed lipids which provides the first indication that active YL DGAT1 and YL DGAT2 proteins can be produced in transgenic seed.

Example 5

Expression of *Yarrowia lipolytica* DGAT Genes in Soybean Somatic Embryos

TABLE 6 and TABLE 7 list promoter and terminator sequences that were used in plasmid constructs for seed specific over-expression of YL DGAT genes.

TABLE 6

Seed-specific Promoters

| Promoter | Organism | Promoter Reference |
|---|---|---|
| β-conglycinin α'-subunit | soybean | Beachy et al., EMBO J. 4: 3047-3053 (1985) |
| kunitz trypsin inhibitor | soybean | Jofuku et al., Plant Cell 1: 1079-1093 (1989) |
| glycinin Gy1 | soybean | WO 2004/071467 |
| BD30 (also called P34) | soybean | WO 2004/071467 |

TABLE 7

Transcription Terminators

| Transcription Terminator | Organism | Reference |
|---|---|---|
| phaseolin 3' | bean | WO 2004/071467 |
| kunitz trypsin inhibitor 3' | soybean | WO 2004/071467 |

Construction of a plasmid construct for expression of the YL DGAT1 gene under control of the glycinin Gy1 promoter (KS349) (FIG. 3).

The isolation of soybean glycinin Gy1 promoter was performed as follows. Based on the sequences of the soybean glycinin Gy1 gene sequence (GenBank Accession No. X15121; SEQ ID NO:35) in the NCBI database, two oligos with either BamHI or NcoI sites at the 5' ends were designed to amplify the soybean glycinin Gy1 promoter (SEQ ID NO:36). The oligonucleotide sequences of these two oligos are as follows:

```
SEQ ID NO: 37 (oGy1-1):
CGCGGATCCTAGCCTAAGTACGTACTCAAAATGCCA

SEQ ID NO: 38 (oGy1-2):
GAATTCCCATGGGGTGATGACTGATGAGTGTTTAAGGAC
```

Plasmid pKS349 was constructed in many steps from a number of different intermediate vectors. The amplified soybean glycinin Gy1 promoter fragment was digested with BamHI and NcoI, purified and cloned into the BamHI and NcoI sites of p24K-G4G-@SalI (PCT Application No. WO 98/59062) to give pZBL114 (SEQ ID NO:39). The NcoI/KpnI fragment containing GUS was replaced with an NcoI/KpnI fragment containing a fusion product of the soybean GY1 gene (SEQ ID NO:40) and the synthetic barley high lysine 8 (BHL8) gene (U.S. Pat. No. 6,800,726 B1) (SEQ ID NO:41) to make pZBL133 (SEQ ID NO:43). The DNA sequence of the fusion product of soy GY1 gene and BHL8 gene is set forth as SEQ ID NO: 42. The phaseolin terminator was removed from pZBL133 (XbaI/filled in) and replaced with the phaseolin terminator found in pKS123 (PCT Application No. WO 02/08269) (blunt) to give pKS238 (SEQ ID NO:44). The GY1-BHL8 fusion was replaced with native GY1 sequence as follows. pKS238 was digested with KpnI/BglI, the remaining vector band (5.1 kb) was ligated to a DNA fragment (BglI/KpnI) of the native GY1 gene (SEQ ID NO:40) to give pKS240 (SEQ ID NO: 45) The BamHI/SalI fragment containing Gy1/GM-GY1/Phas3' was excised from pKS 240 and ligated to the BamHI/SalI sites of pKS120 (SEQ ID NO:46) to give pKS242 (SEQ ID NO:47). Plasmid pKS120 is identical to pKS123 (supra) with the exception that the HindIII fragment containing Bcon/NotI/Phas3' cassette was removed. The NcoI/NotI fragment containing GM-GY1 was replaced with the NcoI/NotI fragment containing YL-DGAT1 from pYDA1 to give pKS349 (SEQ ID NO:48).

Construction of a Construct for Expression of the YL DGAT2 Gene Under the Control of the Betaconglycinin Promoter (KS362) (FIG. 3):

Plasmid pKS362 was constructed in many steps from a number of different intermediate vectors. The AscI cassette containing Kti/NotI/Kti3' from pKS121 (PCT Application No. WO 02/00904) was blunted into the NotI (filled in) site on pBluescript II SK+ (Stratagene) to give pKS121/BS. The NcoI/NotI fragment from pDsRed-Express Vector (Clontech) was blunted into the NotI (filled in) site of pKS121/BS to give pDS-RED in KS121/BS (SEQ ID NO:49). The BamHI cassette containing Kti/DsRed/Kti3' in pDS-RED in KS121/BS (SEQ ID NO:50) was ligated into the BamHI site of pKS123 (PCT Application No. WO 02/08269) to give pKS332 (SEQ ID NO:51). The gene for the YL-DGAT2 was synthesized by PCR with primers to introduce NotI sites at both ends of the gene (see Example 1). The resulting PCR product is digested with NotI restriction enzyme and ligated into the NotI site of pKS332 to give pKS362 (SEQ ID NO:52).

Construction of a Control Plasmid (KS352) (FIG. 2):

Based on the sequences of the cloned soybean P34 promoter (WO 2004/071467) (SEQ ID NO:53), two oligos with either BamH I or NotI sites at the 5' ends were designed to re-amplify the P34 promoter. The oligonucleotide sequences of these two oligos are shown as follows:

```
SEQ ID NO:54 (oP34-1):
CGCGGATCCAACTAAAAAAAGCTCTCAAATTACATTTTGAG

SEQ ID NO:55 (oP34-2):
GAATTCGCGGCCGCAACTTGGTGGAAGAATTTTATGATTTGAAA
```

The re-amplified P34 promoter fragment was digested with BamHI and NotI, purified and cloned into the BamHI and NotI sites of plasmid pZBL115 (SEQ ID NO:56) to make pJS89 (SEQ ID NO:57). The pZBL115 plasmid contains the origin of replication from pRB322, the bacterial HPT hygromycin resistance gene driven by T7 promoter and T7 terminator, and a 35S promoter-HPT-Nos3' gene to serve as a hygromycin resistant plant selection marker. Morteriella alpina delta-6 desaturase gene (U.S. Pat. No. 5,968,809) (SEQ ID NO:58) was cloned into the NotI site of pJS89 (SEQ ID NO:57) in the sense orientation to make the plant expression cassettes and pJS93 (SEQ ID NO:59).

The P34 promoter was excised from pJS93 (SEQ ID NO:59) using SalI NotI double digestion and ligated to SalI/NotI linearized pKS127 vector (U.S. patent application Ser. No. 11/476,510) (SEQ ID NO:60) to give pKS343 (SEQ ID NO:61). The BamHI cassette containing Kti/DsRed/Kti3' in pDS-RED in KS121/BS was blunted and ligated into the HindIII (filled in) site of pKS343 to give pKS352 (SEQ ID NO:62)

Construction of a Plasmid for Co-Expression of YL DGAT1 and YL DGAT2 (KS364):

Plasmid pKS364 (SEQ ID NO:63) was constructed by ligating the 3.3 kb HindIII cassette containing Bcongl PRO/YL-DGAT2/Phas TER from pKS362 (SEQ ID NO:52) into the unique HindIII site downstream of the of the Gy1 promoter in pKS349 (SEQ ID NO:48).

Generation of Transgenic Somatic Embryos:

For co-expression of YL DGAT1 and YL DGAT2 gene in soybean somatic embryos soybean tissue was co-bombarded as described below with a mixture of KS349 and KS362. Briefly, DNA of KS349 was digested with restriction enzymes PstI, XhoI to inactivate the selectable marker gene cassette (CaMV35S PRO/HPT/CaMV NOS TER ). This DNA was mixed in a 10:1 ratio with Sa/1-linearized plasmid DNA of KS362 and used for soybean transformation as outlined below. Alternatively, soybean somatic embryos soybean tissue was bombarded as described below with intact plasmid DNA of KS364 which contains functional expression cassettes for both, YL DGAT1 and YL DGAT2. For expression of YL DGAT1 alone, uncut plasmid DNA of KS349 was used for particle bombardment of embryo tissue. Similarly, for expression of YL DGAT2 alone, uncut plasmid DNA of KS362 was used for particle bombardment of embryo tissue. Moreover, DNA that contained a selectable marker only (KS352) was used for soybean tissue transformation in an identical fashion.

Culture Conditions:

Soybean embryogenic suspension cultures (cv. Jack) were maintained in 35 mL liquid medium SB196 (infra) on a rotary shaker, 150 rpm, 26° C. with cool white fluorescent lights on 16:8 h day/night photoperiod at light intensity of 60-85 pE/m2/s. Cultures were subcultured every 7 days to two weeks by inoculating approximately 35 mg of tissue into 35 mL of fresh liquid SB196 (the preferred subculture interval is every 7 days).

Soybean embryogenic suspension cultures were transformed with the soybean expression plasmids by the method of particle gun bombardment (Klein et al., *Nature* 327:70 (1987)) using a DuPont Biolistic PDS1000/HE instrument (helium retrofit) for all transformations.

Soybean Embryogenic Suspension Culture Initiation:

Soybean cultures were initiated twice each month with 5-7 days between each initiation. Pods with immature seeds from available soybean plants 45-55 days after planting were picked, removed from their shells and placed into a sterilized magenta box. The soybean seeds were sterilized by shaking them for 15 min in a 5% Clorox solution with 1 drop of ivory soap (i.e., 95 mL of autoclaved distilled water plus 5 mL Clorox and 1 drop of soap, mixed well). Seeds were rinsed using 2 1-liter bottles of sterile distilled water and those less than 4 mm were placed on individual microscope slides. The small end of the seed was cut and the cotyledons pressed out of the seed coat. Cotyledons were transferred to plates containing SB199 medium (25-30 cotyledons per plate) for 2 weeks, then transferred to SB1 for 2-4 weeks. Plates were wrapped with fiber tape. After this time, secondary embryos were cut and placed into SB196 liquid media for 7 days.

Preparation of DNA for Bombardment:

Either an intact plasmid or a DNA plasmid fragment containing the genes of interest and the selectable marker gene were used for bombardment.

A 50 µL aliquot of sterile distilled water containing 1 mg of gold particles was added to 5 µL of a 1 µg/µL DNA solution (either intact plasmid or DNA fragment prepared as described above), 50 µL 2.5M $CaCl_2$ and 20 µL of 0.1 M spermidine. The mixture was pulsed 5 times on level 4 of a vortex shaker and spun for 5 sec in a bench microfuge. After a wash with 150 µL of 100% ethanol, the pellet was suspended by sonication in 85 µL of 100% ethanol. Five µL of DNA suspension was dispensed to each flying disk of the Biolistic PDS1000/HE instrument disk. Each 5 µL aliquot contained approximately 0.058 mg gold particles per bombardment (i.e., per disk).

Tissue Preparation and Bombardment with DNA:

Approximately 100-150 mg of 7 day old embryonic suspension cultures were placed in an empty, sterile 60×15 mm petri dish and the dish was placed inside of an empty 150×25 mm Petri dish. Tissue was bombarded 1 shot per plate with membrane rupture pressure set at 650 PSI and the chamber was evacuated to a vacuum of 27-28 inches of mercury. Tissue was placed approximately 2.5 inches from the retaining/stopping screen.

Selection of Transformed Embryos:

Transformed embryos were selected using hygromycin as the selectable marker. Specifically, following bombardment, the tissue was placed into fresh SB196 media and cultured as described above. Six to eight days post-bombardment, the SB196 is exchanged with fresh SB196 containing 30 mg/L hygromycin. The selection media was refreshed weekly. Four to six weeks post-selection, green, transformed tissue was observed growing from untransformed, necrotic embryogenic clusters. Isolated, green tissue was removed and inoculated into multi-well plates to generate new, clonally propagated, transformed embryogenic suspension cultures.

Embryo Maturation:

Transformed embryogenic clusters were cultured for one-three weeks at 26° C. in SB196 under cool white fluorescent (Phillips cool white Econowatt F40/CW/RS/EW) and Agro (Phillips F40 Agro) bulbs (40 watt) on a 16:8 hrphotoperiod with light intensity of 90-120 µE/m²s. After this time embryo clusters were removed to a solid agar media, SB166, for 1 week. Then subcultured to medium SB103 for 3 weeks. Alternatively, embryo clusters were removed to SB228 (SHaM) liquid media, 35 mL in 250 mL Erlenmeyer flask, for 2-3 weeks. Tissue cultured in SB228 was maintained on a rotary shaker, 130 rpm, 26° C. with cool white fluorescent lights on 16:8 h day/night photoperiod at light intensity of 60-85 µE/m2/s. During this period, individual embryos were removed from the clusters and screened for alterations in their fatty acid compositions as described supra.

Media Recipes:

| SB 196 - FN Lite Liquid Proliferation Medium (per liter) | |
|---|---|
| MS FeEDTA - 100x Stock 1 | 10 mL |
| MS Sulfate - 100x Stock 2 | 10 mL |
| FN Lite Halides - 100x Stock 3 | 10 mL |
| FN Lite P, B, Mo - 100x Stock 4 | 10 mL |
| B5 vitamins (1 mL/L) | 1.0 mL |

-continued

| SB 196 - FN Lite Liquid Proliferation Medium (per liter) | |
|---|---|
| 2,4-D (10 mg/L final concentration) | 1.0 mL |
| $KNO_3$ | 2.83 gm |
| $(NH_4)_2SO_4$ | 0.463 gm |
| Asparagine | 1.0 gm |
| Sucrose (1%) | 10 gm |
| pH 5.8 | |

| FN Lite Stock Solutions | | | |
|---|---|---|---|
| Stock Number | | 1000 mL | 500 mL |
| 1 | MS Fe EDTA 100x Stock | | |
| | $Na_2$ EDTA* | 3.724 g | 1.862 g |
| | $FeSO_4$—$7H_2O$ | 2.784 g | 1.392 g |
| 2 | MS Sulfate 100x stock | | |
| | $MgSO_4$—$7H_2O$ | 37.0 g | 18.5 g |
| | $MnSO_4$—$H_2O$ | 1.69 g | 0.845 g |
| | $ZnSO_4$—$7H_2O$ | 0.86 g | 0.43 g |
| | $CuSO_4$—$5H_2O$ | 0.0025 g | 0.00125 g |
| 3 | FN Lite Halides 100x Stock | | |
| | $CaCl_2$—$2H_2O$ | 30.0 g | 15.0 g |
| | KI | 0.083 g | 0.0715 g |
| | $CoCl_2$—$6H_2O$ | 0.0025 g | 0.00125 g |
| 4 | FN Lite P, B, Mo 100x Stock | | |
| | $KH_2PO_4$ | 18.5 g | 9.25 g |
| | $H_3BO_3$ | 0.62 g | 0.31 g |
| | $Na_2MoO_4$—$2H_2O$ | 0.025 g | 0.0125 g |

*Add first, dissolve in dark bottle while stirring

SB1 Solid Medium (Per Liter)

1 package MS salts (Gibco/BRL-Cat. No. 11117-066)
1 mL B5 vitamins 1000× stock
31.5 g Glucose
2 mL 2,4-D (20 mg/L final concentration)
pH 5.7
8 g TC agar

SB199 Solid Medium (Per Liter)

1 package MS salts (Gibco/BRL-Cat. No. 11117-066)
1 mL B5 vitamins 1000× stock
30 g Sucrose
4 ml 2,4-D (40 mg/L final concentration)
pH 7.0
2 gm Gelrite

SB 166 Solid Medium (Per Liter)

1 package MS salts (Gibco/BRL-Cat. No. 11117-066)
1 mL B5 vitamins 1000× stock
60 g maltose
750 mg $MgCl_2$ hexahydrate
5 g Activated charcoal
pH 5.7
2 g Gelrite

SB 103 Solid Medium (Per Liter)

1 package MS salts (Gibco/BRL-Cat. No. 11117-066)
1 mL B5 vitamins 1000× stock
60 g maltose
750 mg MgCl2 hexahydrate
pH 5.7
2 g Gelrite

SB 71-4 Solid Medium (Per Liter)

1 bottle Gamborg's B5 salts w/sucrose (Gibco/BRL-Cat. No. 21153-036)
pH 5.7
5 g TC agar

2,4-D Stock

Obtain premade from Phytotech Cat. No. D 295-concentration 1 mg/mL

B5 Vitamins Stock (per 100 mL)

Store aliquots at −20° C.
10 g Myo-inositol
100 mg Nicotinic acid
100 mg Pyridoxine HCl
1 g Thiamine
If the solution does not dissolve quickly enough, apply a low level of heat via the hot stir plate.

| SB 228- Soybean Histodifferentiation & Maturation (SHaM) (per liter) | |
|---|---|
| DDI H2O | 600 ml |
| FN-Lite Macro Salts for SHaM 10X | 100 ml |
| MS Micro Salts 1000x | 1 ml |
| MS FeEDTA 100x | 10 ml |
| CaCl 100x | 6.82 ml |
| B5 Vitamins 1000x | 1 ml |
| L-Methionine | 0.149 g |
| Sucrose | 30 g |
| Sorbitol | 30 g |
| Adjust volume to | 900 mL |
| pH 5.8 | |
| Autoclave | |
| Add to cooled media (≦30 C): | |
| *Glutamine (Final conc. 30 mM) 4% | 110 mL |

*Note:
Final volume will be 1010 mL after glutamine addition.

Because glutamine degrades relatively rapidly, it may be preferable to add immediately prior to using media. Expiration 2 weeks after glutamine is added; base media can be kept longer w/o glutamine.

| FN-lite Macro for SHAM 10X- Stock #1 (per liter) | |
|---|---|
| $(NH_4)2SO_4$ (Ammonium Sulfate) | 4.63 g |
| $KNO_3$ (Potassium Nitrate) | 28.3 g |
| $MgSO_4$*$7H_2O$ (Magnesium Sulfate Heptahydrate) | 3.7 g |
| $KH_2PO_4$ (Potassium Phosphate, Monobasic) | 1.85 g |
| Bring to volume | |
| Autoclave | |

| MS Micro 1000X- Stock #2 (per 1 liter) | |
|---|---|
| $H_3BO_3$ (Boric Acid) | 6.2 g |
| $MnSO_4$*$H_2O$ (Manganese Sulfate Monohydrate) | 16.9 g |
| ZnSO4*7H20 (Zinc Sulfate Heptahydrate) | 8.6 g |
| $Na_2MoO_4$*2H20 (Sodium Molybdate Dihydrate) | 0.25 g |
| $CuSO_4$*$5H_2O$ (Copper Sulfate Pentahydrate) | 0.025 g |
| $CoCl_2$*$6H_2O$ (Cobalt Chloride Hexahydrate) | 0.025 g |
| KI (Potassium Iodide) | 0.8300 g |
| Bring to volume | |
| Autoclave | |

| FeEDTA 100X- Stock #3 (per liter) | |
|---|---|
| Na₂EDTA* (Sodium EDTA) | 3.73 g |
| FeSO₄*7H₂0 (Iron Sulfate Heptahydrate) | 2.78 g |

*EDTA must be completely dissolved before adding iron.
Bring to Volume
Solution is photosensitive. Bottle(s) should be wrapped in foil to omit light.
Autoclave

| Ca 100X- Stock #4 (per liter) | |
|---|---|
| CaCl₂*2H₂0 (Calcium Chloride Dihydrate) | 44 g |
| Bring to Volume | |
| Autoclave | |

| B5 Vitamin 1000X- Stock #5 (per liter) | |
|---|---|
| Thiamine*HCl | 10 g |
| Nicotinic Acid | 1 g |
| Pyridoxine*HCl | 1 g |
| Myo-Inositol | 100 g |
| Bring to Volume | |
| Store frozen | |

| 4% Glutamine- Stock #6 (per liter) | |
|---|---|
| DDI water heated to 30° C. | 900 ml |
| L-Glutamine | 40 g |

Gradually add while stirring and applying low heat.
Do not exceed 35° C.
Bring to Volume
Filter Sterilize
Store frozen*
*Note:
Warm thawed stock in 31° C. bath to fully dissolve crystals.

Oil Analysis:

Somatic embryos were harvested after two weeks of culture in the liquid maturation medium SB228 (SHaM) liquid media. Approximately 30 events were created in transformations with KS352, KS349/KS362, and KS362 and KS364. All embryos generated for a given event were harvested in bulk and processed as follows. Embryos were frozen on dry ice or by incubation in a −80° C. freezer for two h followed by lyophilization for 48 h.

Dried embryos were ground to a fine powder using a geno-grinder vial (½"×2" polycarbonate) and a steel ball (SPEX Centriprep (Metuchen, N.J., U.S.A.). Grinding time was 30 sec at 1450 oscillations per min. For every event, triplicates of approximately 10 mg of tissue were weighed into Eppendorf tubes. The tissue was extracted using 200 μL heptane at room temperature under continuous shaking for 2 h. Heptane extracts were cleared by centrifugation and 25 μL of extract was derivatized to fatty acid methyl esters as follows. One mL of a 25% sodium methoxide stock solution was added to 24 mL of HPLC grade methanol. Sodium methoxide was stored under an inert gas.

Five μL of a 17:0 TAG (Nu-Chek Prep, Elysian, Minn., USA) stock solution (10 mg/mL) was combined with 25 μL of heptane tissue extract in a glass culture tube 500 μL of 1% sodium methoxide was added. Sample were derivatized in a water bath at 50° C. for 15 min. Samples were allowed to cool to RT and 1 mL of 1 M NaCl was added follwed by brief mixing. FAMEs were extracted into 1 mL of hepatene and 4 μL sample were quantitated by GC analysis.

Data analysis was performed by plotting the oleic content (% of total FAME) against the total FAME content (% DW). TABLE 8 shows that somatic embryos generated with a vector control (KS352) show little fluctuation in oleic acid content and some fluctuation in oil content that can very likely be attributed to biological variation that in introduced in the regeneration process. For example, embryos very likely show variation in their developmental stage at the time of harvesting. In embryos generated with the control construct no correlation (R2=0.1142) was observed between the oleic acid content and the oil content (TABLE 8). In embryos generated with plasmid constructs expressing YL DGAT1 and YL DGAT2 s gene alone, KS349 and KS362, respectively or both YL DGAT1 and DGAT2 genes (KS349/KS362, KS364) under control of strong seed specific promoters both oleic acid content and total esterified fatty acid content showed a wide range of fluctuation. Moreover, as shown in FIGS. 4 and 5, a strong correlation ($R^2 \geq 0.59$) was observed between the oleic acid content and the total esterified fatty acid content for somatic embryos generated with KS349 and KS362 either alone or in combinations as well as with KS364, a transformation plasmid that contains expression cassettes for YL DGAT1 and YL DAT2 genes.

TABLE 8

Esterified Fatty Acid and Oleic Acid Content of Soybean Somatic Embryos

| Event # | FAME (% DCW) | stdv | oleic acid (% total FAME) |
|---|---|---|---|
| KS352 | | | |
| 22 | 6.2 | nd | 18.9 |
| 16 | 5.7 | nd | 15.8 |
| 35 | 5.6 | nd | 19.5 |
| 48 | 5.6 | nd | 18.5 |
| 14 | 5.5 | nd | 17.3 |
| 43 | 5.5 | nd | 18.7 |
| 42 | 5.4 | nd | 19.3 |
| 33 | 5.3 | nd | 17.2 |
| 68 | 5.3 | nd | 18.6 |
| 3 | 5.2 | nd | 18.5 |
| 4 | 5.2 | nd | 18.9 |
| 11 | 5.2 | nd | 19.1 |
| 41 | 5.2 | nd | 16.9 |
| 51 | 5.2 | nd | 18.2 |
| 7 | 5.1 | nd | 17.2 |
| 10 | 5.1 | nd | 19.9 |
| 21 | 5.1 | nd | 18.2 |
| 27 | 5.1 | nd | 18.3 |
| 1 | 5.0 | nd | 17.6 |
| 46 | 5.0 | nd | 18.4 |
| 59 | 5.0 | nd | 17.5 |
| 66 | 5.0 | nd | 19.3 |
| 5 | 4.9 | nd | 15.1 |
| 15 | 4.9 | nd | 15.7 |
| 29 | 4.9 | nd | 16.5 |
| 2 | 4.8 | nd | 17.6 |
| 9 | 4.8 | nd | 17.4 |
| 30 | 4.8 | nd | 17.0 |
| 34 | 4.8 | nd | 16.9 |
| 19 | 4.7 | nd | 14.8 |
| 47 | 4.7 | nd | 17.4 |
| 67 | 4.7 | nd | 22.9 |
| 13 | 4.6 | nd | 17.2 |
| 28 | 4.6 | nd | 15.9 |
| 39 | 4.6 | nd | 18.6 |

TABLE 8-continued

Esterified Fatty Acid and Oleic Acid Content of Soybean Somatic Embryos

| Event # | FAME (% DCW) | stdv | oleic acid (% total FAME) |
|---|---|---|---|
| 44 | 4.6 | nd | 17.1 |
| 65 | 4.6 | nd | 19.4 |
| 6 | 4.5 | nd | 13.9 |
| 24 | 4.5 | nd | 16.1 |
| 31 | 4.5 | nd | 15.9 |
| 20 | 4.4 | nd | 17.1 |
| 37 | 4.4 | nd | 17.3 |
| 69 | 4.4 | nd | 19.2 |
| 50 | 4.3 | nd | 17.2 |
| 54 | 4.3 | nd | 19.5 |
| 55 | 4.3 | nd | 16.1 |
| 64 | 4.3 | nd | 18.7 |
| 32 | 4.1 | nd | 14.4 |
| 61 | 4.1 | nd | 16.8 |
| 23 | 4.0 | nd | 16.1 |
| 26 | 4.0 | nd | 13.6 |
| 49 | 4.0 | nd | 16.5 |
| 18 | 3.9 | nd | 16.4 |
| 8 | 3.8 | nd | 15.5 |
| 53 | 3.8 | nd | 20.2 |
| 63 | 3.8 | nd | 17.2 |
| 52 | 3.7 | nd | 17.3 |
| 17 | 3.6 | nd | 14.3 |
| 36 | 3.6 | nd | 15.7 |
| 60 | 3.4 | nd | 16.6 |
| 12 | 3.3 | nd | 15.4 |
| 45 | 3.3 | nd | 15.2 |
| 62 | 3.3 | nd | 18.8 |
| 40 | 3.2 | nd | 13.3 |
| 25 | 3.0 | nd | 12.3 |
| 38 | 3.0 | nd | 16.2 |
| 57 | 2.5 | nd | 18.0 |
| 56 | 2.3 | nd | 18.2 |
| 58 | 2.2 | nd | 16.5 |
| KS349 | | | |
| 28 | 10.8 | 1.0 | 33.2 |
| 16 | 10.6 | 3.1 | 32.7 |
| 25 | 10.3 | 0.9 | 34.1 |
| 19 | 9.7 | 0.2 | 31.5 |
| 8 | 9.5 | 0.9 | 34.7 |
| 7 | 9.4 | 0.3 | 34.3 |
| 18 | 9.3 | 0.1 | 34.3 |
| 30 | 9.2 | 0.0 | 32.3 |
| 3 | 8.6 | 0.6 | 32.9 |
| 20 | 8.5 | 0.1 | 32.9 |
| 24 | 8.4 | 0.1 | 30.8 |
| 5 | 8.3 | 0.3 | 37.0 |
| 21 | 8.2 | 0.5 | 32.5 |
| 12 | 8.1 | 0.3 | 33.2 |
| 31 | 8.1 | 0.2 | 33.4 |
| 11 | 7.5 | 0.5 | 30.5 |
| 6 | 7.5 | 0.2 | 29.9 |
| 22 | 7.5 | 0.7 | 33.2 |
| 27 | 7.1 | 0.4 | 19.4 |
| 29 | 7.1 | 1.5 | 29.9 |
| 23 | 6.6 | 0.3 | 18.4 |
| 17 | 6.3 | 0.7 | 22.7 |
| 15 | 6.0 | 0.1 | 28.1 |
| 4 | 5.7 | 0.1 | 21.2 |
| 13 | 5.7 | 0.0 | 23.6 |
| 14 | 5.6 | 0.2 | 21.7 |
| 26 | 5.5 | 0.1 | 19.1 |
| 10 | 5.5 | 0.1 | 30.8 |
| 2 | 5.5 | 0.3 | 28.2 |
| 9 | 5.2 | 0.2 | 16.6 |
| 1 | 4.6 | 0.3 | 17.1 |
| KS362 | | | |
| 28 | 14.7 | 0.3 | 28.9 |
| 16 | 14.5 | 0.1 | 33.1 |
| 19 | 14.1 | 0.6 | 32.6 |
| 24 | 13.6 | 0.0 | 29.9 |
| 17 | 13.3 | 0.4 | 31.3 |
| 21 | 12.7 | 0.2 | 28.0 |
| 12 | 12.6 | 0.1 | 30.6 |
| 6 | 11.6 | 1.3 | 32.0 |
| 18 | 11.5 | 0.6 | 26.5 |
| 22 | 10.9 | 0.7 | 23.8 |
| 11 | 10.8 | 0.1 | 27.2 |
| 26 | 10.8 | 0.1 | 25.8 |
| 14 | 10.6 | 0.2 | 25.3 |
| 13 | 10.4 | 0.3 | 22.4 |
| 20 | 9.8 | 0.3 | 21.1 |
| 8 | 9.5 | 0.7 | 21.8 |
| 25 | 9.3 | 0.1 | 19.5 |
| 10 | 9.1 | 0.5 | 21.1 |
| 4 | 8.8 | 0.3 | 23.5 |
| 15 | 8.8 | 0.0 | 19.1 |
| 23 | 7.8 | 0.2 | 16.1 |
| 27 | 7.8 | 0.6 | 18.3 |
| 1 | 7.2 | 0.6 | 20.1 |
| 3 | 7.2 | 0.3 | 18.1 |
| 9 | 7.2 | 0.2 | 14.8 |
| 2 | 6.3 | 0.3 | 17.5 |
| 7 | 6.1 | 0.3 | 22.9 |
| 5 | 4.6 | 0.2 | 17.3 |
| KS349/KS362 | | | |
| 12 | 13.2 | 0.3 | 34.1 |
| 4 | 11.7 | 0.7 | 33.4 |
| 13 | 11.4 | 0.2 | 33.1 |
| 18 | 11.1 | 0.2 | 33.5 |
| 24 | 11.1 | 0.1 | 33.3 |
| 3 | 10.9 | 0.0 | 34.1 |
| 10 | 10.8 | 0.2 | 31.8 |
| 9 | 10.7 | 0.2 | 33.5 |
| 23 | 10.6 | 0.4 | 32.7 |
| 17 | 10.2 | 0.8 | 31.5 |
| 29 | 10.0 | 0.5 | 26.6 |
| 11 | 9.9 | 0.3 | 31.3 |
| 16 | 9.4 | 0.1 | 31.7 |
| 19 | 9.3 | 0.3 | 28.1 |
| 1 | 8.9 | 0.5 | 27.4 |
| 25 | 8.5 | 0.5 | 31.8 |
| 7 | 8.4 | 0.0 | 17.6 |
| 15 | 8.4 | 0.1 | 29.8 |
| 26 | 8.3 | 0.2 | 18.6 |
| 6 | 8.1 | 0.2 | 24.5 |
| 5 | 7.4 | 0.1 | 19.3 |
| 21 | 7.4 | 0.8 | 18.0 |
| 27 | 6.9 | 0.8 | 25.7 |
| 30 | 6.9 | 0.7 | 24.7 |
| 2 | 6.0 | 0.3 | 18.2 |
| 14 | 5.6 | 0.4 | 23.0 |
| 22 | 5.6 | 0.2 | 17.6 |
| 8 | 4.6 | 0.1 | 17.4 |
| 28 | 4.2 | 0.2 | 19.7 |
| 20 | 2.8 | 0.1 | 11.9 |
| KS364 | | | |
| 21 | 16.1 | 0.9 | 35.9 |
| 29 | 14.6 | 2.1 | 33.8 |
| 18 | 14.2 | 2.3 | 33.2 |
| 27 | 13.4 | 0.8 | 31.7 |
| 20 | 12.2 | 0.8 | 35.6 |
| 28 | 11.8 | 0.7 | 34.6 |
| 26 | 11.5 | 1.6 | 30.8 |
| 3 | 11.3 | 1.0 | 36.2 |
| 22 | 10.9 | 1.4 | 34.0 |
| 1 | 10.7 | 0.6 | 30.8 |
| 24 | 10.7 | 0.6 | 31.2 |
| 25 | 10.6 | 0.2 | 31.2 |
| 6 | 10.2 | 0.4 | 32.6 |

TABLE 8-continued

Esterified Fatty Acid and Oleic Acid Content of
Soybean Somatic Embryos

| Event # | FAME (% DCW) | stdv | oleic acid (% total FAME) |
|---|---|---|---|
| 2 | 10.1 | 0.3 | 31.0 |
| 5 | 9.9 | 0.5 | 33.3 |
| 11 | 9.8 | 0.4 | 37.8 |
| 12 | 9.8 | 0.6 | 37.0 |
| 8 | 9.4 | 0.1 | 31.5 |
| 10 | 9.3 | 0.1 | 31.2 |
| 15 | 9.2 | 0.4 | 33.7 |
| 16 | 9.1 | 0.2 | 33.9 |
| 19 | 8.7 | 0.1 | 27.3 |
| 7 | 8.4 | 0.6 | 26.7 |
| 4 | 7.6 | 0.1 | 28.1 |
| 23 | 5.7 | 0.2 | 21.1 |
| 9 | 4.2 | 0.3 | 15.1 |
| 14 | 4.2 | 0.2 | 15.1 |
| 17 | 3.6 | 0.4 | 21.9 |
| 13 | 3.5 | 0.1 | 15.0 |

In summary, the data shows that in soybean somatic embryos, similar to *Arabidopsis* seed YL DGAT gene expression is associated with increased incorporation of oleic acid into the total esterified fatty acid fraction. However, in contrast to *Arabidopsis*, in soybean somatic embryos increased oleic acid content is tightly correlated with total accumulation of esterified fatty acid. In other words, expression of YL DGAT2 alone and co-expression of YL DGAT1 and YL DAGT2 in soybean somatic embryos leads to increased biosynthesis and incorporation of fatty acids into the total esterified fatty acid fraction. Taken together this finding strongly suggests that expression of YL DGAT genes provides an efficient strategy to achieve an increase in the total of oil content of soybean seed.

Example 6

Expression of *Yarrowia lipolytica* DGAT Genes in Soybean Seed

Construction of a control plasmid (KS332) (FIG. 2) containing only CaMV 35S PRO/HPT/NOS TER and Kti PRO/DsRed/Kti TER expression cassettes is described in Example 5. Its sequence is set forth as SEQ ID NO:51.

Transgenic soybean lines were generated by the method of particle gun bombardment (Klein et al., *Nature* (London) 327:70-73 (1987); U.S. Pat. No. 4,945,050) using a BIORAD Biolistic PDS1000/He instrument and plasmid DNA of KS332, KS362 and a 10:1 mixture of KS349 and KS362 prepared as described in Example 3. The following stock solutions and media were used for transformation and regeneration of soybean plants:

Stock Solutions:
Sulfate 100× Stock:
　37.0 g $MgSO_4.7H_2O$, 1.69 g $MnSO_4.H_2O$, 0.86 g $ZnSO_4.7H_2O$, 0.0025 g $CuSO_4.5H_2O$
Halides 100× Stock:
　30.0 g $CaCl_2.2H_2O$, 0.083 g KI, 0.0025 g $CoCl_2.6H_2O$
P, B, Mo 100× Stock:
　18.5 g $KH_2PO_4$, 0.62 g $H_3BO_3$, 0.025 g $Na_2MoO_4.2H_2O$
Fe EDTA 100× Stock:
　3.724 g $Na_2EDTA$, 2.784 g $FeSO_4.7H_2O$ 2,4-D Stock:
　10 mg/mL Vitamin B5 1000× Stock: 10.0 g myo-inositol, 0.10 g nicotinic acid, 0.10 g pyridoxine HCl, 1 g thiamine.
Media (per Liter):
　SB196: 10 mL of each of the above stock solutions, 1 mL B5 Vitamin stock, 0.463 g $(NH_4)_2 SO_4$, 2.83 g $KNO_3$, 1 mL 2,4-D stock, 1 g asparagine, 10 g Sucrose, pH 5.7
SB103:
　1 pk. Murashige & Skoog salts mixture, 1 mL B5 Vitamin stock, 750 mg $MgCl_2$ hexahydrate, 60 g maltose, 2 g gelrite, pH 5.7.
SB166:
　SB103 supplemented with 5 g per liter activated charcoal.
SB71-4:
　Gamborg's B5 salts, 1 mL B5 vitamin stock, 30 g sucrose, 5 g TC agar, pH 5.7.

To prepare tissue for transformation, soybean embryogenic suspension cultures were maintained in 35 mL liquid medium (SB196) on a rotary shaker (150 rpm) at 28° C. with fluorescent lights providing a 16 h day/8 h night cycle. Cultures were subcultured every two weeks by inoculating approximately 35 mg of tissue into 35 mL of fresh liquid media.

In particle gun bombardment procedures it is possible to use purified 1) entire plasmid DNA; or 2) DNA fragments containing only the recombinant DNA expression cassette(s) of interest. For every seventeen bombardment transformations, 85 µL of suspension is prepared containing 1 to 90 picograms (pg) of plasmid DNA per base pair of each DNA plasmid. Both recombinant DNA plasmids were co-precipitated onto gold particles as follows. The DNAs in suspension were added to 50 µL of a 20-60 mg/mL 0.6 µm gold particle suspension and then combined with 50 µL $CaCl_2$ (2.5 M) and 20 µL spermidine (0.1 M). The mixture was vortexed for 5 sec, spun in a microfuge for 5 sec, and the supernatant removed. The DNA-coated particles were then washed once with 150 µL of 100% ethanol, vortexed and spun in a microfuge again, then resuspended in 85 µL of anhydrous ethanol. Five µL of the DNA-coated gold particles were then loaded on each macrocarrier disk.

Approximately 150 to 250 mg of two-week-old suspension culture was placed in an empty 60 mm×15 mm petri plate and the residual liquid removed from the tissue using a pipette. The tissue was placed about 3.5 inches away from the retaining screen and each plate of tissue was bombarded once. Membrane rupture pressure was set at 650 psi and the chamber was evacuated to −28 inches of Hg. Three plates were bombarded, and, following bombardment, the tissue from each plate was divided between two flasks, placed back into liquid media, and cultured as described above.

Seven days after bombardment, the liquid medium was exchanged with fresh SB196 medium supplemented with 30-50 mg/L hygromycin. The selective medium was subsequently refreshed weekly or biweekly. Seven weeks post-bombardment, bright green, transformed tissue was observed growing from untransformed, chlorotic or necrotic embryogenic clusters. Isolated green tissue was removed and inoculated into individual wells in six-well culture dishes to generate new, clonally-propagated, transformed embryogenic suspension cultures. Thus, each new line was treated as independent transformation event in an individual well. These suspensions can then be maintained as suspensions of embryos clustered in an immature developmental stage through subculture or they can be regenerated into whole plants by maturation and germination of individual somatic embryos.

After two weeks in individual cell wells, transformed embryogenic clusters were removed from liquid culture and placed on solidified medium (SB166) containing no hormones or antibiotics for one week. Embryos were cultured for at 26° C. with mixed fluorescent and incandescent lights on a 16 h day/8 h night schedule. After one week, the cultures were then transferred to SB103 medium and maintained in the same growth conditions for 3 additional weeks.

Somatic embryos became suitable for germination after four weeks and were then removed from the maturation medium and dried in empty petri dishes for one to five days. The dried embryos were then planted in SB71-4 medium where they were allowed to germinate under the same light and temperature conditions as described above. Germinated embryos were transferred to sterile soil and grown to maturity for seed production.

A total of 29 transgenic lines with seed were generated with intact plasmid DNA of KS362 at concentration of 15 pg per bp of plasmid DNA per gold particle preparation (see above). For every event 20 seed were scored for the presence of the DS marker gene. Briefly, seeds were observed under a stereo microscope (Leica MZ Fluo III) using a UV light source. A filter set customized for fluorescence associated with DsRed expression with the following properties was used: Exitation $\lambda$=540-580 nm/Emssion $\lambda \geq 570$ nm. In cases were less that 20 seed were available all seed were scored in this manner. Subsequently soybean seed oil content was measured by NMR as described previously 3. Nineteen events generated with KS362 contained seed that were positive for DsRed. Of these, 11 events showed a detectable difference in oil content between DsRed positive transgenic segregants and DsRed negative null segregants. Data are summarized in TABLE 9.

TABLE 9

Oil Content of T1 Soybean Seed Generated with KS362

|  | n | avg % oil null | n | avg % oil DsRed + | delta % points | delta % |
|---|---|---|---|---|---|---|
| AFS4822.4.5.1 | 5 | 13.3 | 15 | 20.4 | 7.2 | 54.1 |
| AFS4822.3.2.1 | 10 | 14.2 | 9 | 18.9 | 4.7 | 32.7 |
| AFS4822.3.3.1 | 5 | 12.4 | 8 | 16.1 | 3.7 | 29.5 |
| AFS4822.4.2.1 | 4 | 16.2 | 6 | 20.9 | 4.7 | 29.3 |
| AFS4822.4.1.1 | 9 | 15.1 | 8 | 19.4 | 4.3 | 28.9 |
| AFS4822.1.13.1 | 5 | 15.3 | 15 | 19.1 | 3.7 | 24.4 |
| AFS4822.1.2.1 | 2 | 15.8 | 18 | 19.6 | 3.8 | 24.1 |
| AFS4822.4.17.1 | 7 | 14.9 | 13 | 18.5 | 3.6 | 23.9 |
| AFS4822.1.9.1 | 8 | 16.9 | 12 | 19.8 | 3.0 | 17.5 |
| AFS4822.2.11.1 | 6 | 17.9 | 14 | 20.7 | 2.8 | 15.7 |
| AFS4822.2.10.1 | 6 | 20.6 | 14 | 23.5 | 2.8 | 13.7 |

A total of 10 transgenic lines with seed were generated with DNA of KS332. For every event 20 seed were scored for the presence of the DS marker gene as described above. In cases were less that 20 seed were available all seed were scored in this manner. Subsequently soybean seed oil content was measured by NMR as described in Example 4. Seven events generated with KS 332 contained seed that were positive for DsRed. Data are summarized in TABLE 10.

TABLE 10

Oil Content of T1 Soybean Seed Generated with KS332

|  | n | avg % oil null | n | avg % oil DsRed+ | delta % points | delta % |
|---|---|---|---|---|---|---|
| AFS4703.1.1.1 | 3 | 21.8 | 17 | 20.5 | -1.4 | -6.2 |
| AFS4703.1.2.1 | 4 | 20.8 | 16 | 18.5 | -2.3 | -11.2 |
| AFS4703.1.6.1 | 5 | 20.4 | 15 | 21.4 | 1.0 | 5.0 |
| AFS4703.2.3.1 | 8 | 22.1 | 12 | 21.1 | -0.9 | -4.1 |
| AFS4703.2.4.1 | 6 | 22.2 | 14 | 21.7 | -0.4 | -2.0 |

TABLE 10-continued

Oil Content of T1 Soybean Seed Generated with KS332

|  | n | avg % oil null | n | avg % oil DsRed+ | delta % points | delta % |
|---|---|---|---|---|---|---|
| AFS4703.3.8.1 | 6 | 21.8 | 14 | 21.8 | 0.0 | 0.2 |
| AFS4703.3.16.1 | 5 | 23.9 | 15 | 23.3 | -0.6 | -2.5 |

In contrast to seed generated with KS362, for transgenic seed generated with KS332 no consistent oil increase could be associated with the presence of the DsRed marker in T1 segregants.

Four events generated with KS362 were subjected to analysis of DsRed status and oil NMR of all available T1 seed. Data are summarized in TABLE 11.

TABLE 11

Oil Content of T1 Soybean Seed Generated with KS362

|  | n | avg % oil null | n | avg % oil DsRed + | delta % points | delta % |
|---|---|---|---|---|---|---|
| AFS4822.4.5.1 | 8 | 12.0 | 24 | 18.3 | 6.3 | 52.9 |
| AFS4822.1.13.1 | 17 | 15.0 | 42 | 18.7 | 3.7 | 24.6 |
| AFS4822.1.2.1 | 4 | 15.7 | 40 | 19.3 | 3.5 | 22.3 |
| AFS4822.2.10.1 | 8 | 19.5 | 25 | 23.0 | 3.5 | 17.8 |
| AFS4822.2.11.1 | 6 | 17.9 | 17 | 20.3 | 2.4 | 13.5 |

In summary, the data in the previous tables and FIG. 7 show that seed specific expression of YL DAGT2 leads to increased oil biosynthesis during soybean seed maturation and thus provides an efficient metabolic engineering tool to increase oil accumulation in soybeans.

A total of 16 transgenic lines with seed were generated by co-bombardment with DNA of KS349 and KS362 that had been mixed at a 10:1 ratio (see Example 4). The DNA mixture was delivered in soybean transformation at a final concentration of 15 pg per bp of plasmid DNA per gold particle preparation. Briefly, prior to bombardment DNA KS349 was digested with PstI, XhoI for inactivation of the selectable marker gene on this plasmid. DNA of KS362 was linearized with SalI. It is reasonable to assume that because of the pre-treatment of the DNA, the selectable marker gene in all transformations was delivered from the plasmid (KS362) that was bombarded at the lower DNA concentration. Initial inspection of these seed under the fluorescence stereo-microcsope revealed that very few events of this transformation contained T1 seed that were positive for the DsRed marker gene. This result may be due to the proximity of the DsRed expression cassette to the end of the SalI restriction fragment of KS362 that was used for soybean transformation. It may have resulted in the integration of KS362 DNA fragments that did not contain a functional DsRed expression cassette. For this reason T1 seed were screened for the absence of presence of the transgene-derived YL DGAT by assaying the seed fatty acid composition. For every event 20 seed were analyzed by GC. 50 seed of untransformed soybean seed were processed in the same manner. Soybean seed chips were produced by cutting the seed with a razorblade avoiding the embryonic axis. Seed chips of approximately 2 mg were placed in a vial containing 50 µL trimethylsulfonium hydroxide and 0.5 mL hexane. The chips were incubated for 30 min at room temperature while shaking. 5 µL of the hexane layer was injected into a Hewlett Packard 6890 Gas Chromatograph containing a Omegawax 320 fused silica capillary column (Supelco Cat. No. 24152). Oven conditions were as follows: initial temperature of 220° C. for 2.7 minutes, ramped to 240° C. over 1 min and held at 240° C. For a total run time of 6 min. Retention times were compared to standards commercially available (Nu-Chek Prep, Inc. Cat. No. U-99-A). Fatty acids were determined by direct trans-esterification of individual standards in 0.5 mL of methanolic $H_2SO_4$ (2.5%). Fatty acid methyl esters were extracted from the methanolic solutions into hexane after the addition of an equal volume of water.

Ten events were identified that contained T1 seed with ≧25% oleic acid content. Since this oleic acid content was not observed in untransformed soybean seed (see FIG. 6 and TABLE 12) and increased oleic acid content was previously associated with YL DGAT2 and YL DGAT1 and YL DGAT2 co-expression both in *arabidopsis* seed and soybean somatic embryos, it is believed that the presence of oleic acid at levels of ≧25% provides efficient means to identify YL DGAT positive T1 seed. After GC analysis for YL DGAT genotyping, seed were subjected to oil measurements by NMR as described previously (Example 3). When oleic acid content was plotted against total oil content seven of the 10 events with T1 seed of ≧25% showed a correlation of $R^2$≧0.3 between oil and oleic acid content. The properties of these events are described in more detail in TABLE 12.

TABLE 12

Oil Content of T1 Soybean Seed Generated with KS349/KS362

| | n | avg % oil <25% oleic | n | avg % oil ≧25% oleic | delta % points | delta % | $R^2$ % oleic/% oil |
|---|---|---|---|---|---|---|---|
| AFS4818.3.1.1 | 15 | 11.9 | 5 | 16.8 | 4.9 | 41.0 | 0.38 |
| AFS4818.1.5.1 | 10 | 15.5 | 10 | 20.0 | 4.5 | 28.7 | 0.69 |
| AFS4818.2.10.1 | 10 | 13.2 | 10 | 16.5 | 3.3 | 25.2 | 0.39 |
| AFS4818.1.9.1 | 5 | 12.9 | 14 | 15.9 | 3.0 | 22.9 | 0.51 |
| AFS4818.2.6.1 | 12 | 18.6 | 8 | 21.9 | 3.4 | 18.1 | 0.51 |
| AFS4818.1.3.1 | 6 | 20.5 | 14 | 23.6 | 3.1 | 14.9 | 0.45 |
| AFS4818.1.2.1 | 6 | 19.4 | 14 | 21.8 | 2.4 | 12.4 | 0.37 |
| Jack (wt control) | 56 | 21.7 | | | | | 0.003 |

Jack wild type seed were grown under similar condition to those used for T1 seed generation and analyzed by GC and NMR analysis. It was observed that oleic acid and oil content fluctuated between 7.6-20.5% and 18.6-25.2%, respectively. No correlation between oleic acid content and oil content could be observed in untransformed soybean seed.

Four events generated with KS349/KS362 were subjected to GC and NMR analysis of all available T1 seed. Data are summarized in TABLE 13.

TABLE 13

Oil Content of T1 Soybean Seed Generated with KS349/KS362

| | n | avg % oil <25% oleic | n | avg % oil ≧25% oleic | delta % points | delta % | $R^2$ % oleic/% oil |
|---|---|---|---|---|---|---|---|
| AFS4818.1.5.1 | 21 | 16.3 | 21 | 20.2 | 3.9 | 23.8 | 0.55 |
| AFS4818.2.6.1 | 49 | 18.1 | 23 | 21.9 | 3.7 | 20.7 | 0.50 |
| AFS4818.1.3.1 | 33 | 20.2 | 67 | 23.5 | 3.3 | 16.2 | 0.43 |
| AFS4818.1.2.1 | 13 | 19.3 | 26 | 22.1 | 2.7 | 14.1 | 0.45 |

Taken together the data in the previous tables and FIGS. 6 and 7 strongly support the conclusion that co-expression of YL DGAT1 and YL DGAT2 genes, like expression of the YL DGAT2 gene alone, provides an efficient strategy to achieve an increase in the total of oil content of soybean seed. Additionally, it should be noted that a high number of events could be identified with an oil difference of ≧2% points between null and transgenic segregants among a small set of transgenic events screened.

Example 7

Expression of *Yarrowia lipolytica* DGAT Genes in Maize

Based on results disclosed in Examples 4, 5 and 6 of the instant application, the YL DGAT1 and YL DGAT2 genes can be expressed in the seed embryo of maize to increase the oil content of this tissue. As described below, this result can be achieved by transforming maize with expression cassettes comprising open reading frames of DGAT1 and DGAT2 from *Yarrowia lipolytica* operably linked on their 5' ends to embryo preferred promoters, such as the promoter for the maize 16 kDa oleosin gene (Lee, K. and Huang, A. H., *Plant Mol. Biol.* 26:1981-1987 (1984)) and maize embryo abundant (EAP1) promoter and terminator (US 2006272058A1).

An expression cassette comprising the promoter from the maize 16 kDa oleosin gene (OLE PRO), the coding sequence of the YL DGAT2 gene (SEQ ID NO:9) and the polyadenylation signal sequence/terminator from the nopaline synthase (NOS) gene of *Agrobacterium tumefaciens* is constructed using methods and technologies known in the art. A second expression cassette comprises the YL DGAT1 gene under the transcriptional control of the maize embryo abundant protein (EAPL) promoter and terminator, with the maize ADH1 INTRON1 inserted between the promoter and coding sequence for enhanced expression. The two expression cassettes are linked, together with a gene encoding a selectable marker, in a binary vector suitable for *Agrobacterium*-mediated transformation of maize.

An *Agrobacterium*-based protocol can be used for the transformation of maize (see below). The resulting binary vector is introduced into *Agrobacterium* LBA4404 (PHP10523) cells, preferably by electroporation. An in vivo recombination generates a cointegrate plasmid between the introduced binary vector and the vir plasmid (PHP10523) resident in the *Agrobacterium* cells. The resulting *Agrobacterium* cells are used to transform maize.

Transformation of Maize Mediated by *Agrobacterium*:

Freshly isolated immature embryos of maize, about ten days after pollination (DAP), can be incubated with the *Agrobacterium*. The preferred genotype for transformation is the highly transformable genotype Hi-II (Armstrong, *Maize Gen. Coop. Newsletter* 65:92-93 (1991)). An F1 hybrid created by crossing a Hi-II with an elite inbred may also be used. After *Agrobacterium* treatment of immature embryos, the embryos can be cultured on medium containing toxic levels of herbicide. Only those cells that receive the herbicide resistance gene, and the linked gene(s), grow on selective medium. Transgenic events so selected can be propagated and regenerated to whole plants, produce seed, and transmit transgenes to progeny.

Preparation of *Agrobacterium*:

The engineered *Agrobacterium tumefaciens* LBA4404 can be constructed to contain plasmids for seed-preferred expression of YL DGAT1 and YL DGAT2 genes, as disclosed in U.S. Pat. No. 5,591,616 (the contents of which are hereby incorporated by reference). To use the engineered construct in plant transformation, a master plate of a single bacterial colony transformed with plasmids for seed-preferred expression of YL DGAT1 and YL DGAT2 genes can be prepared by inoculating the bacteria on minimal AB medium and allowing incubation at 28° C. for approximately three days. (The composition and preparation of minimal AB medium has been previously described in PCT Publication No. WO 02/009040 (the contents of which are hereby incorporated by reference). A working plate can then be prepared by streaking the transformed *Agrobacterium* on YP medium (0.5% (w/v) yeast extract, 1% (w/v) peptone, 0.5% (w/v) sodium chloride, 1.5% (w/v) agar) that contains 50 μg/mL of spectinomycin.

The transformed *Agrobacterium* for plant transfection and co-cultivation can then be prepared one day prior to maize transformation. Into 30 mL of minimal A medium (prepared as described in PCT Publication No. WO 02/009040) in a flask was placed 50 μg/mL spectinomycin, 100 μM acetosyringone, and about a 1/8 loopful of *Agrobacterium* from a one to two-day-old working plate. The *Agrobacterium* can then be grown at 28° C. with shaking at 200 rpm for approximately fourteen h. At mid-log phase, the *Agrobacterium* can be harvested and resuspended at a density of 3 to 5×108 CFU/mL in 561 Q medium that contains 100 μM acetosyringone using standard microbial techniques. The composition and preparation of 561Ω medium was described in PCT Publication No. WO 02/009040.

Immature Embryo Preparation:

Nine to ten days after controlled pollination of a maize plant, developing immature embryos are opaque and 1-1.5 mm long. This length is the optimal size for infection with the PHP18749-transformed *Agrobacterium*. The husked ears can be sterilized in 50% commercial bleach and one drop Tween-20 for thirty minutes, and then rinsed twice with sterile water. The immature embryos can then be aseptically removed from the caryopsis and placed into 2 mL of sterile holding solution consisting of medium 561Ω that contains 100 μM of acetosyringone.

*Agrobacterium* Infection and Co-Cultivation of Embryos:

The holding solution can be decanted from the excised immature embryos and replaced with transformed *Agrobacterium*. Following gentle mixing and incubation for about five minutes, the *Agrobacterium* can be decanted from the immature embryos. Immature embryos were then moved to a plate of 562P medium, the composition of which has been previously described in PCT Publication No. WO 02/009040. The immature embryos can be placed on this media scutellum surface pointed upwards and then incubated at 20° C. for three days in darkness. This step can be followed by incubation at 28° C. for three days in darkness on medium 562P that contains 100 μg/mL carbenecillin as described in U.S. Pat. No. 5,981,840.

Selection of Transgenic Events:

Following incubation, the immature embryos can be transferred to 5630 medium, which can be prepared as described in PCT Publication No. WO 02/009040. This medium contains Bialaphos for selection of transgenic plant cells as conferred by the BAR gene that is linked to barley HGGT expression cassette. At ten to fourteen-day intervals, embryos were transferred to 5630 medium. Actively growing putative transgenic embryogenic tissue can be after six to eight weeks of incubation on the 5630 medium.

Regeneration of T₀ Plants:

Transgenic embryogenic tissue is transferred to 288W medium and incubated at 28° C. in darkness until somatic embryos matured, or about ten to eighteen days. Individual matured somatic embryos with well-defined scutellum and coleoptile are transferred to 272 embryo germination medium and incubated at 28° C. in the light. After shoots and roots emerge, individual plants are potted in soil and hardened-off using typical horticultural methods.

288W medium contains the following ingredients: 950 mL of deionized water; 4.3 g of MS Salts (Gibco); 0.1 g of myo-inositol; 5 mL of MS Vitamins Stock Solution (Gibco); 1 mL of zeatin (5 mg/mL solution); 60 g sucrose; 8 g of agar (Sigma A-7049, Purified), 2 mL of indole acetic acid (0.5 mg/mL solution*); 1 mL of 0.1 mM ABA*; 3 mL of Bialaphos (1 mg/mL solution*); and 2 mL of carbenicillin (50 mg/mL solution). The pH of this solution is adjusted to pH 5.6. The solution is autoclaved and ingredients marked with an asterisk (*) are added after the media has cooled to 60° C.

Medium 272 contains the following ingredients: 950 mL of deionized water; 4.3 g of MS salts (Gibco); 0.1 g of myo-inositol; 5 mL of MS vitamins stock solution (Gibco); 40 g of Sucrose; and 1.5 g of Gelrite. This solution is adjusted to pH 5.6 and then autoclaved.

Example 8

Analysis of Kernel Oil Content

Nuclear Magnetic Resonance (NMR) Analysis:

Seed are imbibed in distilled water for 12-24 hours at 4° C. The embryo is dissected away and stored in a 48 well plate. The samples are lyophilized over-night in a Virtis 24×48 lyophilizer. The NMR (Process Control Technologies—PCT (Ft. Collins, Colo.) is set up as per the manufacturer's instructions. The NMR is calibrated using a series of 5 mm NMR tubes containing precisely measured amounts of corn oil (Mazola). The calibration standards are 3, 6, 9, 12, 15, 18, 21, 27, 33, and 40 mg of oil.

Example 9

Synthesis of YL DGAT1 and YL DGAT2 Genes

Nucleotide sequences encoding YL DGAT1 and YL DGAT2 were designed for optimized expression in soybean seed using methods similar to those described in Wu, G et al. *Nucleic Acids Research* (2007), 35: D76-D79; Villalobos, A. et al. *BMC Bioinformatics* (2006), 7 No pp. given; Wu, G. et al. *Protein Expression and Purification* (2006), 47: 441-445; Richardson, S. M. et al. *Genome Research* (2006), 16: 550-556; Jayaraj, S. et al. *Nucleic Acids Research* (2005) 33: 3011-3016. DNA molecules were synthezised by DNA 2.0 (Menlo Park, Calif., USA). Expression-optimized DNA sequences of YL DGAT1 and YL DGAT2 are set forth in SEQ ID NO:64 and SEQ ID NO:66, respectively. The amino acid sequences for soy optimized enzymes are set forth in SEQ ID NO:65 (YL DGAT1) and SEQ ID NO:67 (YL DGAT2) and are identical to the translation products of SEQ ID NO:1 and SEQ ID NO:9, respectively.

Example 10

Fatty Acid Composition of Soybean Somatic Embryos Expressing YL DGAT Genes

Transgenic somatic embryos were generated using the plasmid constructs KS352, KS349, KS362 and KS364. Generation of the DNA constructs and the transformation process is described in detail in EXAMPLE 5. Fatty acid composition was determined by GC analysis of fatty acid methyl esters generated by sodium methoxide derivatization of heptane extracts. The findings are summarized in TABLE 14. The table compares the fatty acid composition of 100 events generated with a control plasmid lacking YL DGAT genes with that of events created with plasmids containing YL DGAT1

(KS349), YL DGAT2 (KS362) or both genes (KS364). For events generated with YL DGAT containing DNA constructs the average fatty acid composition of all events with greater than 30% oleic is shown.

TABLE 14

Fatty Acid Composition of Soybean Somatic Embryos generated with KS 352, 349, 362, 349&362 and 364

| Plasmid | n | palmitic acid | stearic acid | oleic acid | linoleic acid | linolenic acid |
| --- | --- | --- | --- | --- | --- | --- |
| KS352 average | 100 | 15.9 | 5.2 | 17.9 | 44.1 | 16.9 |
| KS352 range | | 12.6-20.8 | 4.2-6.6 | 12.3-22.9 | 39.3-46.9 | 12.4-23.5 |
| KS349 average (>30% oleic) | 18 | 11.6 | 5.4 | 33.0 | 41.3 | 8.6 |
| KS349 range (>30% oleic) | | 10.7-12.8 | 4.2-6.5 | 30.5-37.0 | 38.7-44.6 | 7.8-10.7 |
| KS362 average (>30% oleic) | 5 | 11.5 | 6.3 | 31.9 | 43.2 | 6.9 |
| KS362 range (>30% oleic) | | 10.9-12.7 | 5.7-7.0 | 30.6-33.1 | 41.9-44.8 | 6.2-7.7 |
| KS349&362 average (>30% oleic) | 14 | 12.8 | 5.4 | 33.8 | 39.7 | 8.4 |
| KS349&362 range (>30% oleic) | | 11.5-14.4 | 3.8-7.0 | 30.8-35.5 | 38-42.7 | 6.3-10.3 |
| KS364 average (>30% oleic) | 14 | 10.9 | 6.4 | 39.0 | 38 | 5.7 |
| KS364 range (>30% oleic) | | 9.2-12.6 | 5.9-7.7 | 32.8-48.6 | 31.4-42.7 | 3.2-6.5 |

The table shows that expression of YL DGAT1 or YL DGAT2 as well as co-expression of said genes alters the FA profile of soybean somatic embryos. The most pronounced alteration is an increase in oleic acid and a decrease in linolenic acid that is consistently observed with all DNA constructs tested. Expression of YL DGAT genes also leads to a decrease in palmitic and linoleic acid and an increase in stearic acid.

Example 11

Fatty Acid Composition of Soybean Seed Expressing YL DGAT Genes

Event AFS4822.1.13.1 was generated using plasmid DNA of KS362 as described in EXAMPLE 6. Transgenic T1 seed show an increase in oil content of 24.6% when compared to null segregant seed from the same T1 plant. This observation strongly supports the conclusion that this events expresses YL DGAT2. T1 seed of AFS4822.1.13.1 with or without the YL DGAT2 transgene were germinated and grown in the growth chamber for three month. DS-red positive T1 seed of event AFS4703.1.6 were germinated and grown alongside the YL DGAT2 event. AFS4703.1.6 was generated with KS332, a plasmid vector hat contains the DS-red marker gene but does not contain YL DGAT2 (see EXAMPLE 5). Several T1 segregants could be identified that only produced DS-red positive T2 seed indicating that these lines were homozygous for the respective transgene. T2 seed harvested from null-segregant progeny were DS-red negative confirming that these lines likely did not contain a functional transgene.

For each selection six seed were chipped and the fatty acid composition of the seed chips was analyzed by TMSH-derivatization followed by gas chromatography as described in EXAMPLE 6. TABLE15A compares the average fatty acid composition of six seed chips of DS-red positive segregants of AFS4822.1.13.1 with that of seed chips derived form a null-segregant plant and that of seed chips of event AFS4703.1.6 containing only the DS-red marker gene. It demonstrates that expression of YL DGAT2 alters the FA profile of soybean seed. The most pronounced alteration is an increase in oleic acid and a decrease in linolenic acid. Expression of YL DGAT genes also leads to a decrease in palmitic and linoleic acid and an increase in stearic acid.

TABLE 15A

Fatty Acid Composition of T2 Soybean Seed Generated with KS362

| Event | n | palmitic acid | stearic acid | oleic acid | linoleic acid | linolenic acid |
| --- | --- | --- | --- | --- | --- | --- |
| AFS4822.1.13.1 average (DS red positive) | 6 | 10.8 | 4.6 | 29.2 | 49.5 | 6.0 |
| AFS4822.1.13.1 average (Null segregant) | 6 | 12.0 | 3.4 | 16.3 | 59.0 | 9.4 |
| AFS4703.1.6 average (DS red positive) | 6 | 11.5 | 3.3 | 15.8 | 59.8 | 9.6 |

Figures 8A, 8B:
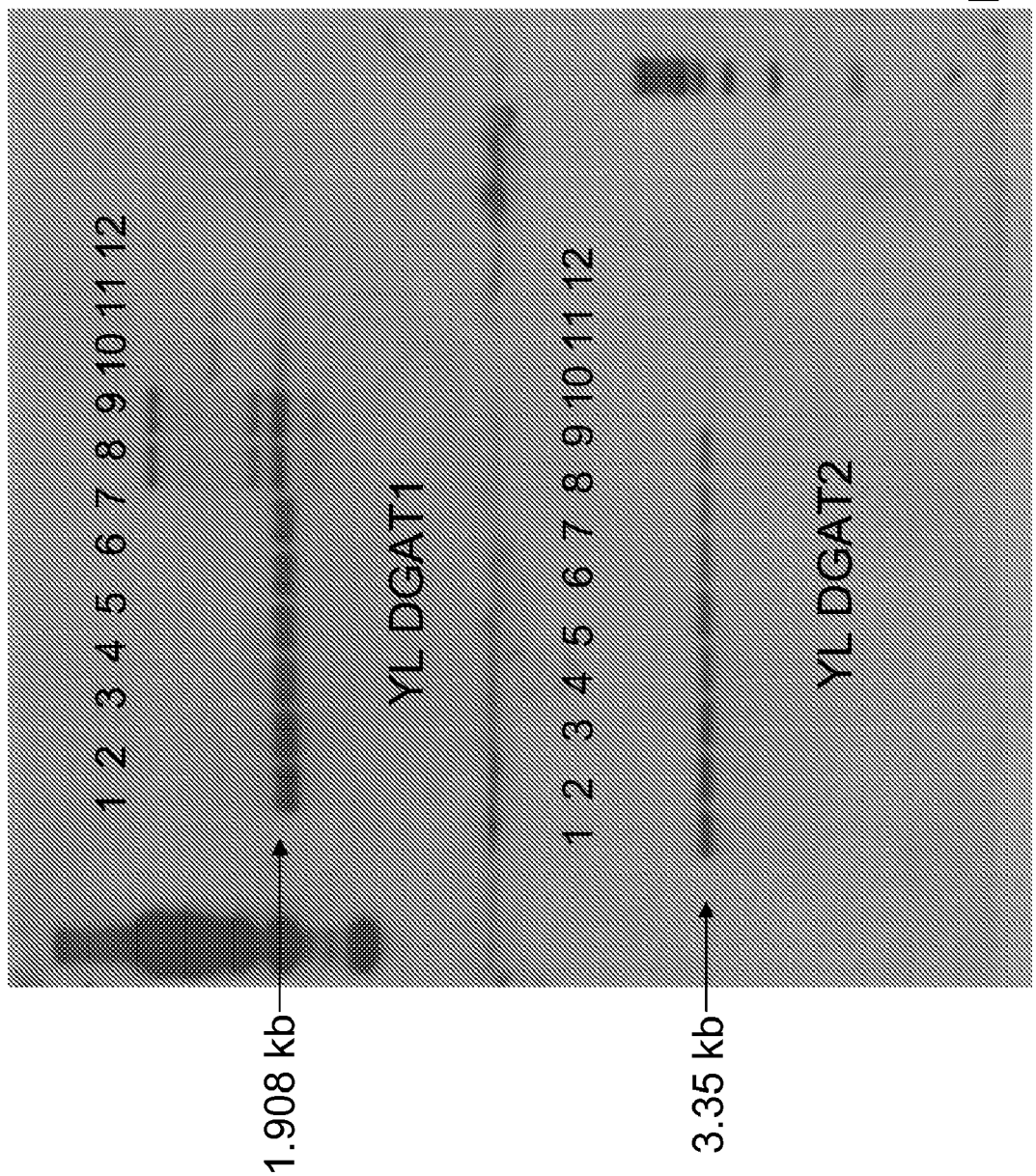

Events AFS4818.1.9 and AFS4818.1.3 were generated using a mixture of DNA fragments derived from plasmids KS349 (YL DGAT1) and KS362 (YL DGAT2) as described in EXAMPLE 5. Transgenic T1 seed of these two events show an increase in oil content of 22.9 and 16.2%, respectively when compared to null segregant seed from the same T1 plant. Although this observation strongly supports the conclusion that both events express transgene derived YL DGAT it is not clear if both events contain intact copies of both or just one DGAT gene present in the DNA mixture used for transformation. T1 seed with increased oil and oleic acid content (see Example 6) were planted for events AFS4818.1.2, AFS4818.1.3, AFS4818.1.5, AFS48182.6, AFS4818.1.9. DNA was isolated, digested with the two restriction enzymes EcoRI and HindIII and transferred to nylon membranes using standard protocols. Duplicate blots were produced and hybridized independently with probes corresponding to a 1.21 kb restriction fragment of the YL DGAT1 gene (generated by digestion of KS349 with NcoI/EcoRI) and the intact YL DGAT2 genes (generated by NotI digestion of KS 362). Based on the sequence of KS 349 (SEQ ID NO:48) and KS 362 (SEQ ID NO: 52) insertion of an intact copy of YL DGAT1 and YL DGAT2 gene in the soybean genome would be indicated by a strong hybridization signal of restriction fragments with a size of ≧1.908 and ≧3.335 kb, respectively. In keeping with this, all events showed strongly hybridizing bands of ≧1.908 kb when a YL DGAT1 probe was used (FIG. 8 A). No hybridization signal was observed when DNA from unmodified soybeans was used (lanes 11 and 12, FIGS. 8A and B). This demonstrates that all events tested have insertions of at least one copy of the intact YL DGAT1 expression cassette present on KS 349. However when DNA of YL DGAT2 was used in hybridization experiments, event 4818.1.9 did only show a very weakly hybridizing band of high MW whereas all other events tested showed strongly hybridizing bands of ≧3.335 kb (lane 9, FIG. 8B). Next genomic DNA of all five events was digested with BstXI, transferred to nylon membranes and probed with intact YL DGAT2 DNA generated as described above (FIG. 9). Insertion of an intact copy of the YL DGAT2 expression cassette would be indicated by strongly hybridizing bands of 0.584 kb (internal fragment) and additional fragments of ≧0.2 and ≧0.77 kb. All events except 4818.1.9 show the hybridization pattern indicative of complete insertion of YL DGAT2. It was concluded that 4818.1.9 only contains a functional expression unit for YL DGAT1.

T1 plants of events 4818.1.9 and 4818.1.3 that were derived from seed with increased oil and oleic content of event 4818.1.9 and 4818.1.3 were grown to maturity and seed were harvested. Fatty acid composition of T2 seed was determined by TMSH-derivatization and GC analysis of seed chips derived from T2 seed. Table compares fatty acid composition of transgenic and null segregant seed from a T2 plant of 4818.1.9 and 4818.1.3 (Table 15B). It demonstrates that expression of YL DGAT1 as well as co-expression of YL DGAT1 and YL DGAT2 alters the FA profile of soybean seed. The most pronounced alteration is an increase in oleic acid and a decrease in linolenic acid. Expression of YL DGAT genes also leads to a decrease in palmitic and linoleic acid and an increase in stearic acid.

TABLE 15B

Fatty Acid Composition of T2 Soybean Seed Generated by co-transformation with KS349 and KS362

| Event | n | palmitic acid | stearic acid | oleic acid | linoleic acid | linolenic acid |
|---|---|---|---|---|---|---|
| AFS4818.1.9 average | 58 | 10.8 | 4.5 | 27.9 | 49.6 | 7.2 |
| AFS4818.1.9 average (Null segregant) | 42 | 12.2 | 3.4 | 14.3 | 57.0 | 13.0 |
| AFS4818.1.3 average | 34 | 10 | 4.2 | 31.6 | 48.7 | 5.5 |
| AFS4818.1.3 average (Null segregant) | 14 | 11.4 | 3.0 | 16.4 | 58.7 | 10.5 |

Example 12

Analysis of Transgenic Events: Growth Chamber

The present example describes measurements of oil content of soybean derived form T2 plants that were homozygous or heterozygous for transgenes comprising YL DGAT1 or YL DGAT2 or both YL DGAT genes. T2 plants were grown in a controlled environment (growth chamber).

Oil analysis of T2 soybean seed derived from plants grown in a plant growth chamber was performed by NMR. Seed were harvested form individual plants. Seed selections from heterozygous plants derived form transformations with the DGAT2 gene from *Yarrowia* showed segregation of the DS red marker. Oil content of DS red positive seed (with DGAT2 transgene) and null segregant seed from the same plant is shown in Table 16. In said table oil content of seed containing the DGAT2 transgene is compared to that of non-transgenic null segregant seed from the same plant.

TABLE 16

Oil content of transgenic seed and null segregant seed derived from transgenic soybean T2 plants that segregate for transgene with the *yarrowia* DGAT2 gene

| Event | PLANT | average oil (%) w transg. | n | average oil (%) null | n | Δ% points | Δ% |
|---|---|---|---|---|---|---|---|
| 4822.1.13 | A | 22.2 | 37 | 19.6 | 11 | 2.3 | 11.5 |
| | B | 21.4 | 27 | 19.5 | 13 | | |
| | average | 21.8 | | 19.6 | | | |
| 4822.4.5 | A | 22.3 | 35 | 18.4 | 13 | 3.6 | 19.6 |
| | B | 22.5 | 38 | 18.5 | 10 | | |
| | C | 21.7 | 31 | 17.7 | 17 | | |
| | D | 22.7 | 31 | 18.2 | 17 | | |
| | E | 21.7 | 23 | 18.9 | 17 | | |
| | average | 22.2 | | 18.6 | | | |
| 4822.1.9 | A | 22.9 | 33 | 20.4 | 7 | 2.5 | 12.3 |
| 4822.2.10 | A | 24.3 | 62 | 20.1 | 24 | 3.3 | 16.3 |
| | B | 23 | 30 | 19.5 | 10 | | |
| | C | 22.5 | 23 | 20.5 | 17 | | |
| | average | 23.3 | | 20.0 | | | |

T2 seed selections of events generated by co-transformation of KS349 and KS362 were screened by GC analysis of seed chips as described above (Example 6). Seed were harvested from individual plants. Seed selections from heterozygous plants derived from transformations with *Yarrowia* DGAT genes segregated for elevated oleic acid content (>22% of total FA). Example 11 describes that event 4818.1.9 only contains an intact expression cassette for the DGAT1 gene from *Yarrowia*. Oil content of seed with elevated oleic acid content (with DGAT1 transgene) and null segregant seed from the same plant is shown in Table 17. In this table, oil content of seed containing the DGAT1 transgene was compared to that of non-transgenic null segregant plants from the same plant.

TABLE 17

Oil content of transgenic seed and null segregant seed derived from transgenic soybean T1 plants that segregate for a transgene with the *yarrowia* DGAT1 gene

| Event | PLANT | average oil (%) w transg. | n | average oil (%) null | n | Δ% points | Δ% |
|---|---|---|---|---|---|---|---|
| 4818.1.9 | A | 21.8 | 58 | 18.9 | 42 | 4.4 | 25.1 |
| | B | 21.3 | 16 | 17.0 | 6 | | |
| | C | 23.1 | 34 | 17.0 | 14 | | |
| | average | 22.1 | | 17.6 | | | |

Example 11 describes that other events generated by co-transformation of KS349 and KS362 contain an intact expression cassette for both DGAT genes of *Yarrowia*. Oil content of seed with elevated oleic acid content (with both DGAT transgenes) and null segregant seed from the same plant is shown in Table 18. In this table, oil content of seed containing both DGAT trangenes was compared to that of non-transgenic null segregant plants from the same plant.

TABLE 18

Oil content of transgenic seed and null segregant seed derived from transgenic soybean T1 plants that segregate for transgenes with DGAT1 and DGAT2 genes from *yarrowia*

| Event | PLANT | average oil (%) w transg. | n | average oil (%) null | n | Δ % points | Δ % |
|---|---|---|---|---|---|---|---|
| 4818.1.2 | A | 23.9 | 33 | 20 | 15 | 3.4 | 17.3 |
| | B | 22.9 | 35 | 20.3 | 13 | | |
| | C | 23 | 31 | 19.2 | 17 | | |
| | average | 23.3 | | 19.8 | | | |
| 4818.1.3 | A | 24.5 | 32 | 21.6 | 16 | 3.4 | 16.3 |
| | B | 23.6 | 34 | 19.5 | 14 | | |
| | C | 25.3 | 28 | 22 | 20 | | |
| | average | 24.5 | | 21.0 | | | |
| 4818.2.6 | A | 22.3 | 31 | 19 | 17 | 3.2 | 15.8 |
| | B | 24.1 | 21 | 20.6 | 27 | | |
| | C | 24.1 | 23 | 20.7 | 25 | | |
| | D | 23.2 | 30 | 20.6 | 18 | | |
| | average | 23.4 | | 20.2 | | | |

T2 seed selection homozygous for the KS362 derived *Yarrowia* DGAT2 expression cassette no longer segregated for the DS red marker. Oil content of 48 seed (or all available seed if less than 48 seed were available) was measured by NMR. For each event DS-red negative T1 seed were planted and T2 seed of null segregants were harvested from plants grown in the same growth chamber used for cultivation of T1 plants homozygous for the DGAT transgene. Oil content of seed derived form null segregant selections and lines homozygous for the DGAT transgene in shown in Table 19.

TABLE 19

Oil content of null segregant seed and transgenic seed derived from transgenic soybean T1 plants that are homozygous for transgenes with *yarrowia* DGAT2 gene

| EVENT | PLANT | n | average oil (%) | Δ % points | Δ % |
|---|---|---|---|---|---|
| 4822.1.13 | A | 48 | 22.7 | 2.3 | 11.6 |
| | B | 48 | 21.9 | | |
| | C | 48 | 22.7 | | |
| | average | | 22.4 | | |
| | NULL-A | 48 | 19.7 | | |
| | NULL-B | 48 | 20.5 | | |
| | average | | 20.1 | | |
| 4822.1.9 | A | 48 | 23.0 | 3.6 | 18.5 |
| | B | 48 | 24.0 | | |
| | C | 48 | 22.7 | | |
| | average | | 23.2 | | |
| | NULL-A | 48 | 19.6 | | |
| 4822.2.10 | A | 48 | 22.5 | 2.3 | 10.9 |
| | B | 48 | 24.4 | | |
| | average | | 23.5 | | |
| | NULL-A | 48 | 20.9 | | |
| | NULL-B | 48 | 21.4 | | |
| | average | | 21.2 | | |

T2 seed selection homozygous for KS349-derived *Yarrowia* DGAT1 and KS362-derived DGAT2 expression cassettes no longer segregated with respect to the elevated oleic acid phenotype (≧22% oleic) associated with expression of *Yarrowia* DGAT genes. Oil content of 48 seed (or all available seed if less than 48 seed were available) was measured by NMR. For each event T1 null segregant seed that showed no elevation oleic acid of were planted and T2 seed of these null segregants were harvested from plants grown in the same growth chamber used for cultivation of T1 plants homozygous for the DGAT transgenes. Oil content of seed derived form null segregant selections and lines homozygous for the DGAT transgene in shown in Table 20.

TABLE 20

Oil content of null segregant seed and transgenic seed derived from transgenic soybean T1 plants that are homozygous for transgenes with DGAT1 and DGAT2 genes from *yarrowia*

| EVENT | PLANT | n | average oil (%) | Δ % points | Δ % |
|---|---|---|---|---|---|
| 4818.1.2 | A | 35 | 23.9 | 3.8 | 18.5 |
| | B | 48 | 24.1 | | |
| | average | | 24.0 | | |
| | NULL-A | 48 | 20.1 | | |
| | NULL-B | 48 | 20.4 | | |
| | average | | 20.3 | | |
| 4818.1.3 | A | 48 | 24.4 | 4.5 | 22.8 |
| | B | 48 | 24.4 | | |
| | C | 48 | 24.3 | | |
| | average | | 24.4 | | |
| | NULL-A | 48 | 20.2 | | |
| | NULL-B | 48 | 19.5 | | |
| | average | | 19.9 | | |
| 4818.1.5 | A | 48 | 24.4 | 4.8 | 24.2 |
| | B | 13 | 24.4 | | |
| | C | 48 | 25.1 | | |
| | average | | 24.6 | | |
| | NULL-A | 48 | 19.4 | | |
| | NULL-B | 48 | 20.2 | | |
| | average | | 19.8 | | |
| 4818.2.6 | A | 46 | 24.2 | 3.1 | 14.4 |
| | NULL-A | 11 | 21.4 | | |
| | NULL-B | 48 | 20.9 | | |
| | average | | 21.2 | | |

In summary, growth chamber results show excellent heritability of the increased oil trait associated with overexpression of either a single *Yarrowia* DGAT genes or co-expression of both *Yarrowia* DGAT genes in soybean seed. Oil increase (compared to null segregant seed) associated with expression of a single *Yarrowia* DGAT genes is at least 10.9% and as high as 25.1%. Oil increase (compared to null segregant seed) associated with expression of both *Yarrowia* DGAT genes is at least 14.4% and as high as 24.2%.

Example 13A

Analysis of Transgenic Events: Field

The present example describes measurements of oil content of soybean derived from T2 plants that were homozygous or heterozygous for transgenes comprising YL DGAT1 or YL DGAT2 or both YL DGAT genes. T2 plants were grown in a non-controlled environment (field).

DS red positive T1 seed of transgenic events generated with YL DGAT2 (contained in KS 362) and corresponding DS red negative null segregant seed were grown in a field in Iowa in the summer of 2007. T1 seed with elevated oleic acid content that had been generated by co-transformation with YL DGAT1 and YL DGAT2 and corresponding null segregant seed with normal levels of oleic acid were grown in a similar fashion. T2 seed were harvested from individual plants and subjected to NMR analysis to measure oil content. Table 21 shows oil content of 48 uniformly DS red positive seed derived from events that were homozygous for the KS362 transgene and that of DS-red negative seed from null segregant seed of the same event grown in the same environment.

TABLE 21

Oil content null segregant seed and transgenic seed derived from field-grown transgenic soybean T1 plants that are homozygous for transgenes with the *yarrowia* DGAT2 gene

| EVENT | PLANT | n | average oil (%) | Δ % points | Δ % |
|---|---|---|---|---|---|
| 4822.1.2 | A | 48 | 22.4 | 2.4 | 13 |
| | B | 48 | 20.5 | | |
| | C | 48 | 21.5 | | |
| | E | 48 | 21.7 | | |
| | F | 48 | 20.7 | | |
| | G | 40 | 19.5 | | |
| | H | 16 | 23 | | |
| | average | | 21.3 | | |
| | Null A | 48 | 18.9 | | |
| | Null B | 48 | 19 | | |
| | Null C | 48 | 18.7 | | |
| | Null D | 16 | 17.9 | | |
| | Null E | 24 | 20.2 | | |
| | average | | 18.9 | | |
| 4822.2.11 | A | 48 | 22.1 | 2.6 | 14 |
| | B | 47 | 21 | | |
| | C | 48 | 23.8 | | |
| | D | 48 | 21.1 | | |
| | E | 48 | 23.1 | | |
| | F | 48 | 22 | | |
| | G | 48 | 20.4 | | |
| | H | 48 | 20.8 | | |
| | I | 48 | 20.3 | | |
| | average | | 21.6 | | |
| | Null A | 48 | 19.2 | | |
| | Null B | 48 | 19.5 | | |
| | Null C | 48 | 18.3 | | |
| | average | | 19.0 | | |
| 4822.2.10 | A | 40 | 21.8 | 2.6 | 13.6 |
| | B | 48 | 21.8 | | |
| | average | | 21.8 | | |
| | Null A | 48 | 18.6 | | |
| | Null B | 48 | 19.2 | | |
| | Null C | 48 | 19.2 | | |
| | Null E | 16 | 19.7 | | |
| | Null F | 48 | 19.7 | | |
| | Null G | 48 | 19 | | |
| | average | | 19.2 | | |

Table 22 shows oil content of 48 seed from segregants that were homozygous for YL DGAT1 and YL DGAT2 transgenes. All seed harvested from these homozygous T2 seed selections showed the elevated oleic acid content associated with YL DGAT expression. In Table 22 oil content of these lines is compared to that of null segregant seed of the same events with unaltered levels of oleic acid, derived from plants grown in the same environment.

TABLE 22

Oil content null segregant seed and transgenic seed derived from field-grown transgenic soybean T1 plants that are homozygous for transgenes with the *yarrowia* DGAT1 and DGAT2 genes.

| EVENT | PLANT | n | average oil (%) | Δ % points | Δ % |
|---|---|---|---|---|---|
| 4818.1.2 | A | 37 | 22.2 | 3.8 | 20 |
| | B | 48 | 22.5 | | |
| | C | 48 | 22.7 | | |
| | D | 48 | 22.6 | | |
| | E | 48 | 24.3 | | |
| | F | 40 | 21.5 | | |
| | average | | 22.6 | | |
| | Null A | 48 | 17.9 | | |
| | Null B | 48 | 18.9 | | |
| | Null C | 48 | 19.4 | | |
| | Null D | 48 | 19.5 | | |
| | Null E | 48 | 19.7 | | |
| | Null F | 48 | 18.4 | | |
| | Null G | 48 | 17.9 | | |
| | average | | 18.8 | | |
| 4818.1.3 | A | 48 | 23.5 | 3.5 | 19 |
| | B | 48 | 22.4 | | |
| | C | 48 | 22.8 | | |
| | D | 19 | 21.3 | | |
| | E | 48 | 20.5 | | |
| | F | 48 | 22.3 | | |
| | G | 48 | 22.8 | | |
| | H | 48 | 22.5 | | |
| | average | | 22.3 | | |
| | Null A | 48 | 18.4 | | |
| | Null B | 48 | 19.1 | | |
| | Null C | 48 | 17.9 | | |
| | Null D | 48 | 19 | | |
| | Null E | 48 | 19.3 | | |
| | Null F | 48 | 18.3 | | |
| | Null G | 48 | 18.3 | | |
| | average | | 18.6 | | |

Example 11 describes that event 4818.1.9 only contains an intact expression cassette for the DGAT1 gene from *Yarrowia*. Three T1 plants of this event derived from T1 seed with elevated oleic acid content were grown in the Iowa field along side null segregant plants derived from T1 seed with unaltered oleic acid content. T2 seed from all three transgenic segregants still showed segregation of the elevated oleic acid phenotype indicating that the parental lines were still heterozygous for the DGAT1 transgene. Using GC analysis all transgene-positive seed were identified from these lines and subjected to oil analysis by NMR. In Table 23 oil content of these seed is compared to that of null segregant seed derived from T1 plants gown in the same environment.

TABLE 23

Oil content null segregant seed and transgenic seed derived from field-grown transgenic soybean T1 plants that are heterozygous for transgenes with the *yarrowia* DGAT1 gene.

| EVENT | PLANT | n | average oil (%) | Δ % points | Δ % |
|---|---|---|---|---|---|
| 4818.1.9 | A | 14 | 20.7 | 2.0 | 11 |
| | B | 14 | 19.1 | | |
| | C | 20 | 20 | | |
| | average | | 20.0 | | |
| | Null A | 40 | 18.1 | | |
| | Null B | 40 | 17.8 | | |
| | average | | 18.0 | | |

In summary, field environment results show excellent heritability of the increased oil trait associated with overexpression of either a single *Yarrowia* DGAT genes or co-expression of both *Yarrowia* DGAT genes in soybean seed. Oil increase (compared to null segregant seed) associated with expression of a single *Yarrowia* DGAT genes is at least 11% and as high as 14%. Oil increase (compared to null segregant seed) associated with expression of both *Yarrowia* DGAT genes is at least 19% and as high as 20%.

Example 13B

Compositional Analysis of Soybean Seed

The present example describes measurements of seed compositional parameters such as protein content and content of soluble carbohydrates of soybean seed derived from transgenic events that express single YL DGAT genes (YL DGAT2) of both YL DGAT genes.

Changes in the composition of soybean seed associated with expression of YL DGAT genes were measured. To this end the concentrations of protein, soluble carbohydrates and starch were measured as follows.

Non-Structural Carbohydrate and Protein Analysis.

Dry soybean seed were ground to a fine powder in a Geno-Grinder and subsamples were weighed (to an accuracy of 0.1 mg) into 13×100 mm glass tubes; the tubes had Teflon® lined screw-cap closures. Three replicates were prepared for each sample tested. Tissue dry weights were calculated by weighing sub-samples before and after drying in a forced air oven for 18 h at 105 C.

Lipid extraction was performed by adding 2 ml aliquots of heptane to each tube. The tubes were vortex mixed and placed into an ultrasonic bath (VWR Scientific Model 750D) filled with water heated to 60 C. The samples were sonicated at full-power (~360W) for 15 min and were then centrifuged (5 min×1700 g). The supernatants were transferred to clean 13×100 mm glass tubes and the pellets were extracted 2 more times with heptane (2 ml, second extraction, 1 ml third extraction) with the supernatants from each extraction being pooled. After lipid extraction 1 ml acetone was added to the pellets and after vortex mixing, to fully disperse the material, they were taken to dryness in a Speedvac.

Non-Structural Carbohydrate Extraction and Analysis.

Two ml of 80% ethanol was added to the dried pellets from above. The samples were thoroughly vortex mixed until the plant material was fully dispersed in the solvent prior to sonication at 60 C for 15 min. After centrifugation, 5 min× 1700 g, the supernatants were decanted into clean 13×100 mm glass tubes. Two more extractions with 80% ethanol were performed and the supernatants from each were pooled. The extracted pellets were suspended in acetone and dried (as above). An internal standard β-phenyl glucopyranoside (100 ul of a 0.5000+/−0.0010 g/100 ml stock) was added to each extract prior to drying in a Speedvac. The extracts were maintained in a desiccator until further analysis.

The acetone dried powders from above were suspended in 0.9 ml MOPS (3-N[Morpholino]propane-sulfonic acid; 50 mM, 5 mM $CaCl_2$, pH 7.0) buffer containing 100U of heat stable α-amylase (from *Bacillus lichenifonnis*; Sigma A-4551). Samples were placed in a heat block (90 C) for 75 min and were vortex mixed every 15 min. Samples were then allowed to cool to room temperature and 0.6 ml acetate buffer (285 mM, pH 4.5) containing 5U amyloglucosidase (Roche 110 202 367 001) was added to each. Samples were incubated for 15-18 h at 55 C in a water bath fitted with a reciprocating shaker; standards of soluble potato starch (Sigma S-2630) were included to ensure that starch digestion went to completion.

Post-digestion the released carbohydrates were extracted prior to analysis. Absolute ethanol (6 ml) was added to each tube and after vortex mixing the samples were sonicated for 15 min at 60 C. Samples were centrifuged (5 min×1700 g) and the supernatants were decanted into clean 13×100 mm glass tubes. The pellets were extracted 2 more times with 3 ml of 80% ethanol and the resulting supernatants were pooled. Internal standard (100 ul β-phenyl glucopyranoside, as above) was added to each sample prior to drying in a Speedvac.

Sample Preparation and Analysis

The dried samples from the soluble and starch extractions described above were solubilized in anhydrous pyridine (Sigma-Aldrich P57506) containing 30 mg/ml of hydroxylamine HCl (Sigma-Aldrich 159417). Samples were placed on an orbital shaker (300 rpm) overnight and were then heated for 1 hr (75 C) with vigorous vortex mixing applied every 15 min. After cooling to room temperature 1 ml hexamethyldisilazane (Sigma-Aldrich H-4875) and 100 ul trifluoroacetic acid (Sigma-Aldrich T-6508) were added. The samples were vortex mixed and the precipitates were allowed to settle prior to transferring the supernatants to GC sample vials.

Samples were analyzed on an Agilent 6890 gas chromatograph fitted with a DB-17MS capillary column (15m×0.32 mm×0.25 um film). Inlet and detector temperatures were both 275 C. After injection (2 ul, 20:1 split) the initial column temperature (150 C) was increased to 180 C at a rate 3 C/min and then at 25 C/min to a final temperature of 320 C. The final temperature was maintained for 10 min. The carrier gas was $H_2$ at a linear velocity of 51 cm/sec. Detection was by flame ionization. Data analysis was performed using Agilent ChemStation software. Each sugar was quantified relative to the internal standard and detector responses were applied for each individual carbohydrate (calculated from standards run with each set of samples). Final carbohydrate concentrations were expressed on a tissue dry weight basis.

Protein Analysis

Protein contents were estimated by combustion analysis on a Thermo Finnigan Flash 1112EA combustion analyzer. Samples, 4-8 mg, weighed to an accuracy of 0.001 mg on a Mettler-Toledo MX5 micro balance were used for analysis. Protein contents were calculated by multiplying % N, determined by the analyzer, by 6.25. Final protein contents were expressed on a % tissue dry weight basis.

TABLE 24

Compositional analysis of soybean seed derived from two T1 plants that were either a null segregant or homozygous for an YL DGAT1 YL DGAT2 transgene. The plants were grown in the same growth chamber environment. If not indicated otherwise values are reported as g/kg DW.

| Event | | Pinitol | Sorbitol | Fructose | Glucose | Myo-Inositol | Sucrose | Raffinose | Stachyose | Total g/kg | Starch | Protein (% DW) |
|---|---|---|---|---|---|---|---|---|---|---|---|---|
| 4818.1.5 NULL | Mean | 1.57 | 0.26 | 4.60 | 1.61 | 0.27 | 47.0 | 8.01 | 35.88 | 99.2 | 0.45 | 38.6 |
| | SD | 0.03 | 0.02 | 0.18 | 0.27 | 0.01 | 1.6 | 0.15 | 0.72 | 2.0 | 0.03 | 0.3 |
| 4818.1.5 TG | Mean | 1.31 | 0.24 | 2.67 | 0.79 | 0.31 | 21.2 | 5.08 | 32.60 | 64.2 | 0.03 | 43.4 |
| | SD | 0.09 | 0.00 | 0.07 | 0.02 | 0.01 | 0.4 | 0.11 | 1.21 | 1.7 | 0.02 | 0.2 |

TABLE 25

Compositional analysis of soybean seed derived from a T1 plant that was heterozygous for an YL DGAT2 transgene. The plant was grown in a growth chamber. YL DGAT transgenic seed and null segregant seed were selected based on DS red expression as a visible marker. Eight DS red positive and DS red-negative seed were combined and analyzed as described above. If not indicated otherwise values are reported as g/kg DW.

| Event | | Pinitol | Sorbitol | Fructose | Glucose | Myo-Inositol | Sucrose | Raffinose | Stachyose | Total g/kg | Starch | Protein (% DW) |
|---|---|---|---|---|---|---|---|---|---|---|---|---|
| 4822.2.10 | Mean | 1.66 | 0.17 | 5.50 | 2.57 | 0.28 | 47.2 | 6.64 | 45.0 | 108.9 | 0.31 | 40.2 |
| NULL | SD | 0.12 | 0.04 | 1.76 | 0.87 | 0.09 | 0.2 | 0.68 | 1.6 | 3.1 | 0.05 | 0.7 |
| 4822.2.10 | Mean | 2.02 | 0.19 | 5.02 | 1.72 | 0.33 | 32.7 | 6.91 | 41.4 | 90.3 | 0.31 | 40.8 |
| TG | SD | 0.06 | 0.01 | 0.33 | 0.18 | 0.02 | 1.0 | 0.18 | 0.6 | 1.5 | 0.11 | 0.9 |

TABLE 26

Compositional analysis of soybean seed derived from T1 plants that were heterozygous for a YL DGAT2 or a YL DGAT1 YL DGAT2 transgene. The plants were grown in the field. YL DGAT transgenic seed and null segregant seed were selected based on DS red expression (4822.2.10) as a visible marker or elevated oleic acid content determined by GC analysis (4818.1.2). Eight transgene-positive and transgene-negative seed were combined and analyzed as described above. If not indicated otherwise values are reported as g/kg DW.

| Event | | Pinitol | Sorbitol | Fructose | Glucose | Myo-Inositol | Sucrose | Raffinose | Stachyose | Total g/kg | Starch | Protein (% DW) |
|---|---|---|---|---|---|---|---|---|---|---|---|---|
| 4822.2.10 | Mean | 2.44 | 0.26 | 1.16 | 1.12 | 0.44 | 57.7 | 8.5 | 39.0 | 110.6 | 3.20 | 41.5 |
| NULL | SD | 0.05 | 0.01 | 0.05 | 0.02 | 0.00 | 0.7 | 0.4 | 0.5 | 1.3 | 0.55 | 0.5 |
| 4822.2.10 | Mean | 1.89 | 0.35 | 0.82 | 0.67 | 0.32 | 29.7 | 5.5 | 31.7 | 70.9 | 1.00 | 46.1 |
| TG | SD | 0.06 | 0.09 | 0.14 | 0.06 | 0.01 | 1.5 | 0.1 | 0.5 | 2.2 | 0.23 | 0.7 |
| 4818.1.2 | Mean | 1.79 | 0.51 | 1.17 | 1.12 | 0.37 | 49.8 | 6.1 | 42.0 | 102.8 | 0.51 | 44.5 |
| NULL | SD | 0.02 | 0.01 | 0.13 | 0.13 | 0.01 | 2.6 | 0.4 | 2.4 | 5.1 | 0.07 | 2.2 |
| 4818.1.2 | Mean | 1.87 | 0.32 | 0.71 | 0.52 | 0.40 | 35.7 | 6.0 | 37.7 | 83.2 | 0.35 | 46.4 |
| TG | SD | 0.05 | 0.02 | 0.05 | 0.01 | 0.02 | 0.8 | 0.2 | 1.5 | 2.5 | 0.08 | 0.2 |

Tables 24-26 illustrate that expression one or two YL DGAT genes in different environments (growth chamber, field) is associated with a consistent shift in seed composition that is characterized by a reduction in soluble carbohydrates, namely a reduction in sucrose and to a smaller extent a reduction in stachyose. Most importantly there is no reduction in protein content observed when oil accumulation is increased through expression of YL DGAT genes.

Example 14

Measurements of DGAT Activity in Developing Seed and Somatic Embryos

The present example describes construction of soybean expression vectors comprising *Yarrowia* DGAT2 alone or *Yarrowia* DGAT2 and DGAT1, expression of these gene(s) in soybean seed or somatic embryos and DGAT enzyme activity in these tissues.

Construction of pKR1234 Comprising YL DGAT2

The NotI fragment of KS362 (SEQ ID NO:52), containing the YL DGAT2, was cloned into the NotI fragment of pKR72 (SEQ ID NO:26; Example 4) to produce pKR1234 (SEQ ID NO:68).

Construction of pKR1236 Comprising YL DGAT1 and DGAT2

The glycinin Gy1 promoter was PCR amplified from pZBL119 (which is described in PCT Publication No. WO 2004/071467 and the contents of which are hereby incorporated by reference) using primers oSGly-2 (SEQ ID NO:69) and oSGly-3 (SEQ ID NO:70). The resulting PCR fragment was subcloned into the intermediate cloning vector pCR-Script AMP SK(+) (Stratagene), according to the manufacturer's protocol, to produce plasmid pPSgly32 (SEQ ID NO:71).

The PstI/NotI fragment of plasmid pSGly32 (SEQ ID NO:71), containing the Gy1 promoter, was cloned into the PstI/NotI fragment from plasmid pKR142 (which is described in PCT Publication No. WO 2004/071467), containing the leguminA23' transcription termination region, an ampicillin resistance gene, and bacterial ori, to produce pKR264 (SEQ ID NO:72). Thus, vector pKR264 contains a NotI site flanked by the promoter for the glycinin Gy1 gene and the leguminA2 3' transcription termination region (Gy1/NotI/legA2 cassette).

The NcoI/XbaI fragment of KS349 (SEQ ID NO:48), containing *Yarrowia* DGAT1, was cloned into the NcoI/XbaI sites of pKR908, (BB1574; published in US20080095915), which contains NcoI/XbaI sites flanked by NotI sites, to produce pKR1212 (SEQ ID NO:73).

The NotI fragment of pKR1212 (SEQ ID NO:73), containing the *Yarrowia* DGAT1 gene, was cloned into the NotI site of pKR264 (SEQ ID NO:72) to produce pKR1235 (SEQ ID NO:74).

The BsiWI fragment of pKR1235 (74), containing the *Yarrowia* DGAT1, gene was cloned into the BsiWI site of pKR1234 (SEQ ID NO:68) to produce pKR1236 (SEQ ID NO:75).

DGAT assays on microsomal extracts from developing T2 seed Soybean embryogenic suspension cultures (cv. Jack) were transformed with KS362 as described herein (Example 6), comprising *Yarrowia* DGAT2, as described herein and T1 seed from soy plants AFS4822.1.13.1 (seed called 7GR11-58) and AFS4822.2.10.1 (seed called 7GR11-66) were planted and plants grown as described in Example 12. In both of these events seed oil concentration of transgene positive seed was found to be elevated when compared to null segregant seed of the same event.

Similarly, soybean embryogenic suspension cultures (cv. Jack) were co-transformed with KS362 (comprising YL DGAT2) and KS349 (comprising YL DGAT1) as described herein (Example 6). Transgene-positive T1 seed from event AFS4818.1.2.1 are represented by seed 7GR11-2. In this event, seed oil concentration of transgene positive seed was found to be elevated when compared to null segregant seed of the same event (Example 6). Transgene-negative, null segregant T1 seed derived from AFS4818.1.2.1 and AFS4818.1.3.1 are represented by 7GR11-7 and 7GR11-15. These seed were planted and plants grown as described in Example 12.

Approximately 1 g of T2 seed were collected from selected plants 30 days after flowering (DAF) and were snap frozen in liquid nitrogen and stored at −80 C until ready to process. After grinding 1 g of frozen seed tissue in liquid nitrogen in a mortar and pestle, 3 mL of plant homogenization buffer (300 mM sucrose; 1 mM EDTA; 10 mM Tris.HCl, pH 8.0; 1 mM DTT; 0.1% polyvinylpolypyrrolidine) was added and tissue was further homogenized using a polytron homogenizer for 1 minute. Debris was collected by vacuum filtration through 3 layers of cheese cloth followed by filtration through 1 layer of mira cloth. The resulting filtrate was centrifuged for 15 min. twice at 1,500×g and the resulting supernatant was then centrifuged at 100,000×g for 60 min. The resulting pellet was responded in approximately 0.5 to 1 mL of microsome buffer (100 mM potassium phosphate, pH 7.2) by gentle pipetting followed by further resuspension in a 2 mL sized Teflon-coated Dounce homogenizer. Protein concentrations were determine using Bradford reagent (Sigma-Aldrich) and microsomes were snap frozen in liquid nitrogen and stored at −80 C until assayed.

DGAT assays were carried out for 5 min at 25° C. in plant assay buffer (500 mM Tricine, pH 7.8; 28 mM sodium chloride; 0.06% CHAPS), with 20 μM 1-14C-labeled oleoyl-coenzyme A (50 mCi/mmol, Perkin Elmer), 1.5 mM dioleoylglyceride (Sigma-Aldrich) and 20 μg of microsomal protein in a total reaction volume of 100 μl. Each reaction was initiated by addition of the microsomal membranes to the remainder of the reaction components. Assays were terminated by the addition of 1 mL of hot isopropanol (75 C) and heating at 75 for 10 min. Assays were cooled to RT, 1.5 mL of hexane was added and samples were mixed. Phases were separated by low speed centrifugation after addition of 1.25 ml of 500 mM sodium sulfate and the upper phase was transferred to another glass tube. The top phase was then dried under nitrogen gas. The lipid from each assay was re-dissolved in 75 uL of hexane spiked with 1 uL of soybean oil. Lipid was applied to a Partisil K6 Silica Gel 60 A TLC plate (Whatman, 250 um thickness, 20 cm×20 cm) and triglycerides were separated from other lipids by development with 80:20:1 (v/v/v) hexane:diethylether:acetic acid. Triacylglycerol was visualized and marked by light staining in iodine vapor in a tank. The plate was removed from the iodine tank and after the stain faded, the triacylglycerol was scraped, and radioactivity determined by liquid scintillation counting and expressed as dpm per min. Total activity was determined as the amount of radiolabeled oleic acid incorporated into triacylglycerol per minute per mg of protein using the following formula: ([dpm]/[2200000 dpm/uCi]/[50 uCi/umol]/[5 min.]/[0.02 mg protein]×[1000 nmol/umol]). DGAT activities for each of the samples described are shown in Table 27.

TABLE 27

DGAT activities for selected developing T2 seed

| Exp. | Plasmid | DGAT | Event | T1 plant | T1 Seed | T1 Seed Oil Phenotype | T2 Developing Seed DGAT Activity (nmol · min−1 · mg−1) |
|---|---|---|---|---|---|---|---|
| 4818 | KS362 KS349 | DGAT2 DAGT1 | AFS4818.1.2 | AFS4818.1.2.1 | 7GR 11-2 | DGAT | 2.8 |
| 4818 | KS362 KS349 | DGAT2 DAGT1 | AFS4818.1.2 | AFS4818.1.2.1 | 7GR 11-7 | null | 0.4 |
| 4818 | KS362 KS349 | DGAT2 DAGT1 | AFS4818.1.3 | AFS4818.1.3.1 | 7GR 11-15 | null | 0.4 |
| 4822 | KS362 | DGAT2 | AFS4822.1.13 | AFS4822.1.13.1 | 7GR 11-58 | DGAT | 2.4 |
| 4822 | KS362 | DGAT2 | AFS4822.2.10 | AFS4822.2.10.1 | 7GR 11-66 | DGAT | 1.6 |

DGAT Assays on Microsomal Extracts from Soybean Somatic Embryos

Soybean embryogenic suspension cultures (cv. Jack) were transformed with either pKR1234 (SEQ ID NO:68), comprising *Yarrowia* DGAT2 and having experiment number MSE2181, or with pKR1236 (SEQ ID NO:75), comprising *Yarrowia* DGAT2 and DGAT1 and having experiment number MSE2182. Events were selected and somatic embryos matured in SHaM as described in Example 5.

After 2 weeks of maturation in SHaM, approximately 1 g of tissue from each event was frozen in liquid nitrogen and tissue was ground with a mortar and pestle as described for soybean developing seed. A small amount of ground tissue (approximately 100 mg) was lyophilized overnight and the remaining tissue was stored at −80 C.

Oil concentrations were determined on approximately 10 mg of lyophilized tissue from each event using the GC method and 17:0 internal standard exactly as described in Example 5 and results for oil concentrations and oleic acid content (% of total FAME) are shown in Table 28. Microsomal protein preparations were made, protein concentrations determined and DGAT assays were carried out on selected events determined to have a range of oil concentrations exactly as previously described for seed tissue. Results for DGAT assays are also shown in Table 28.

TABLE 28

Esterified Fatty Acid, Oleic Acid Content and DGAT
activities of Soybean Somatic Embryos Transformed
with either pKR1234 or pKR1236

| Event # | FAME (% DCW) | oleic acid (% total FAME) | DGAT Activity (nmol · min$^{-1}$ · mg$^{-1}$) |
|---|---|---|---|
| MSE2181-pKR1234 (YL DGAT2) | | | |
| 8 | 8.9 | 31.9 | 3.6 |
| 5 | 7.3 | 33.8 | 4.5 |
| 3 | 6.6 | 32.6 | 2.5 |
| 9 | 6.2 | 30.7 | 2.5 |
| 7 | 6.1 | 30.4 | |
| 16 | 5.8 | 25.4 | 1.6 |
| 12 | 5.6 | 26.1 | |
| 15 | 5.4 | 26.7 | 2.8 |
| 4 | 4.6 | 22.5 | 0.7 |
| 11 | 4.2 | 22.7 | 0.5 |
| 14 | 4.0 | 21.2 | |
| 13 | 3.8 | 23.2 | 1.8 |
| 6 | 3.5 | 25.3 | |
| 10 | 3.2 | 21.2 | 0.5 |
| MSE2182-pKR1236 (YL DGAT2/YL DGAT1) | | | |
| 2 | 10.9 | 38.8 | 6.3 |
| 7 | 10.8 | 38.8 | |
| 4 | 10.3 | 38.4 | 5.1 |
| 3 | 10.0 | 38.0 | |
| 8 | 9.8 | 38.1 | 4.4 |
| 17 | 9.6 | 29.3 | |
| 10 | 8.6 | 33.3 | 5.7 |
| 28 | 8.2 | 36.3 | |
| 13 | 8.1 | 43.6 | |
| 5 | 8.0 | 25.4 | |
| 20 | 8.0 | 36.4 | |
| 12 | 7.7 | 29.3 | 4.8 |
| 26 | 7.6 | 30.5 | |
| 24 | 7.2 | 33.4 | |
| 9 | 6.3 | 20.4 | 0.7 |
| 29 | 6.3 | 29.8 | |
| 21 | 6.1 | 31.1 | |
| 19 | 5.7 | 32.5 | |
| 6 | 5.6 | 21.7 | 0.5 |
| 23 | 5.6 | 33.5 | |
| 16 | 5.4 | 26.3 | |
| 25 | 5.1 | 20.3 | |
| 14 | 5.1 | 26.2 | 0.9 |
| 1 | 5.0 | 24.9 | |
| 18 | 4.9 | 22.2 | |
| 30 | 4.5 | 17.0 | 0.4 |
| 27 | 3.7 | 19.7 | |
| 15 | 3.2 | 21.6 | |
| 11 | 2.9 | 16.6 | 2.5 |
| 22 | 2.8 | 20.7 | |

Events transformed with pKR1234 and having some of the highest oil concentrations had increases in DGAT activity of up to 9-fold compared with those events having wild-type levels of oil. Events transformed with pKR1236 and having some of the highest oil concentrations had increases in DGAT activity of up to 15.8-fold compared with those events having wild-type levels of oil.

Soybean embryogenic suspension culture (cv. Jack) was also transformed with KS364 (SEQ ID NO:63), comprising *Yarrowia* DGAT2 and DGAT1 (Experiment # MSE2134) and individual events were analyzed for fatty acid profile and oil concentration as described in Example 5. Based on this data, one event (Event 54) having high oleic acid (32.83% of total fatty acids) and oil concentrations (12.5% DCWt) and one event (Event 33) having wild-type levels of oleic acid (15.52% of total fatty acids) and oil concentrations (8.2% DCWt) were chosen for DGAT assays. Transformed embryogenic suspension culture from each event was bulked up in SB 196 media and embryos matured in SHaM as described in Example 5.

After 2 weeks of maturation in SHaM, approximately 1 g of tissue from each event was frozen in liquid nitrogen, microsomal protein preparations were made and DGAT assays were carried out on each event exactly as previously described and results are shown in Table 29. Total lipid was also extracted and oleic acid and oil concentrations were determined as described below and results are reported in Table 29.

TABLE 29

Esterified Fatty Acid, Oleic Acid Content and DGAT activities of
Soybean Somatic Embryos Transformed with KS364
KS364 (DGAT2/DGAT1)

| Event # | FAME (% DCW) | oleic acid (% total FAME) | DGAT Activity (nmol · min$^{-1}$ · mg$^{-1}$) |
|---|---|---|---|
| 33 | 8.2 | 15.5 | 0.3 |
| 54 | 12.7 | 32.1 | 3.2 |

The event having the high oil concentration (Event 54) had increases in DGAT activity of 10.7-fold compared with the event having wild-type levels of oil (Event 33).

Example 15

Analysis of Lipid Fractions of Transgenic Seed and Somatic Embryos Expressing DGAT Genes Soy somatic embryos transformed with KS364 from an event with wild-type concentrations of oil and oleic acid (Event 33) and from an event with high concentrations of oil and oleic acid (Event 54) were lyophilized for 48 hr and tissue was ground using a genogrinder exactly as described in Example 5.

Total Lipid Extraction

Total lipid was extracted from each event by the method of Bligh, E. G. & Dyer, W. J. (*Can. J. Biochem. Physiol.* 37:911-917 (1959)) with some modifications. Briefly, approximately 100 mg of ground tissue from each event was added to a 16 mm×125 mm sized test-tube with a teflon-lined screw cap lid. A mixture of methanol:chloroform/2:1 (6 mL) was added and the sample was extracted with gentle mixing for 1 hr after which 2 mL of chloroform was added followed by continued mixing for 30 min. Afterwards, 3.6 mL of water was added, the tube was vortexed vigorously and phases were separated by centrifugation in a clinical centrifuge. The lower organic layer was gently removed to a second glass test tube and the upper aqueous layers were re-extracted with 2 mL of chloroform. Centrifugation was repeated and the lower organic phase was combined with the first organic phase. Samples were dried under a stream of nitrogen at 50 C, total lipid was estimated by weighing and lipid was dissolved in chloroform:methanol/6:1 to a concentration of approximately 10 mg/mL. FAME analysis was carried out on approximately 50 ug of each sample using the sulfuric acid/methanol procedure described herein (Example 4) and results are shown in Table 30.

Separation of Neutral and Polar Lipids

Sep-pak amino-propyl solid phase extraction columns (Waters; 6 cc columns, WAT054560) were equilibrated with 5 mL of methanol followed by 5 mL of methanol:chloroform/1:1 followed by 5 mL of chloroform. Approximately 5 mg of total lipid in chloroform:methanol/6:1 was added to each column, followed by 5×1 mL aliquots of chloroform to elute neutral lipids and all fractions were collected, combined and dried under a stream of nitrogen at 50 C. Polar lipids were then eluted from each column using 5×1 mL aliquots of methanol:chloroform/1:1 followed by 5×1 mL aliquots of methanol and all fractions were combined and dried under nitrogen. Neutral lipids were dissolved in approximately 1 mL of $CHCl_3$:MeOH/6:1 and polar lipids were dissolved in approximately 200 uL of $CHCl_3$:MeOH/6:1. FAME analysis was carried out on approximately 50 ug of neutral lipid using the sulfuric acid/methanol procedure described herein (Example 4) and results are shown in Table 30.

Separation of TAG, PC and PE by TLC

Approximately 100 uL of neutral lipid extract was loaded 2 cm from the bottom of a Partisil K6 Silica Gel 60 A TLC plate (Whatman, 250 um thickness, 20 cm×20 cm). Similarly, approximately 200 uL of the polar lipid fraction was loaded onto the same TLC plate. Standard solutions (10 mg/mL in chloroform:methanol/6:1) of TAG, PC and PE were also spotted onto the plates. TLC plates were developed in CHCl3:MeOH:AcOH/65:35:8 until solvent front was approximately half way up the plate. TLC plates were then air dried for 10 min and developed fully in 70:30:1 (v/v/v) hexane:diethyl-ether:acetic acid. Standards were visualized by light staining with iodine vapour and corresponding bands for TAG, PC and PE were cut out of the TLC plate. Silica gel containing each lipid species was derivatized directly with sulfuric acid/methanol as described herein (Example 4) and results are shown in Table 30.

Fatty Acid Positional Analysis of TAG

Fatty acid profiles of the sn2 position of TAG were determined using porcine pancreatic lipase to remove acyl groups from the sn1 and sn3 position of TAG only, followed by transesterification of the resulting monoacylglyceride (MAG) produced. Approximately 5 mg of neutral lipid extract was suspended in 2 mL of 1 M Tris.HCl, pH 8.0 along with 0.2 mL of 2.2% calcium chloride and 0.5 mL of 0.05% Bile salts in a glass screw cap test tube. The lipid was incubated at 37 C for 5 min, 5 mg of porcine pancreatic lipase was added directly and the suspension was incubated with shaking at 37 C for 20 min. After incubation, the reaction was reaction was terminated with the addition of 1 mL of ethanol followed by 1 mL of 6 M HCl. After mixing, 2.5 mL of diethyl ether was added, phases were separated by centrifugation and the top organic layer was removed carefully. The diethyl ether extraction was repeated and the top diethyl ether phase was combined with the first. After drying over anhydrous sodium sulfate, the diethyl ether was evaporated under a stream of nitrogen at 50 C and the resulting lipid was dissolved in 200 uL of chloroform:methanol/6:1. The lipid was loaded onto a Partisil K6 TLC plate along with triacylglyceride (TAG), diacylglyceride (DAG), monoacylglyceride (MAG) and free fatty acid (FFA) standards and the TLC plate was developed as described herein. Afterwards, standards were visualized with light iodine staining and the MAG band was cut and derivatized with methanol/sulfuric acid as previously described herein. Results for the fatty acid profile of FAME from the MAG band, representing the fatty acid profile of the sn2 position of TAG (i.e. the acyl group on C2 of glycerol), along with the calculated sn1 and sn3 positions, is shown in Table 30. In Table 30, the % of total fatty acid for each fatty acid (i.e. 16:0, 18:0, 18:1, 18:2, 18:3) at the sn1 and sn3 positions of TAG is calculated with the following formula: = ([TAGx]-[sn2x]/3)*3/2; where the x indicates the fatty acid of interest.

TABLE 30

Fatty acid composition of various lipid species and positional distribution in TAG

| Sample | Event | % Oil | 16:0 | 18:0 | 18:1 | 18:2 | 18:3 |
|---|---|---|---|---|---|---|---|
| Total | 33 | 8.2 | 15.6 | 3.9 | 15.5 | 50.8 | 14.2 |
| Extract | 54 | 12.7 | 10.5 | 4.7 | 32.1 | 43.9 | 8.8 |
| Neutral | 33 | 8.2 | 14.4 | 3.7 | 17.0 | 52.5 | 12.4 |
| lipids | 54 | 12.7 | 9.8 | 5.3 | 36.0 | 42.3 | 6.6 |
| TAG | 33 | 8.2 | 18.2 | 4.8 | 20.8 | 47.4 | 8.7 |
|  | 54 | 12.7 | 11.8 | 5.8 | 40.7 | 37.0 | 4.6 |
| PC | 33 | 8.2 | 34.1 | 10.6 | 17.2 | 33.8 | 4.3 |
|  | 54 | 12.7 | 21.5 | 10.0 | 32.1 | 33.7 | 2.7 |
| PE | 33 | 8.2 | 41.1 | 6.8 | 13.4 | 25.9 | 12.8 |
|  | 54 | 12.7 | 45.8 | 9.8 | 21.9 | 15.3 | 7.1 |
| TAG-sn1 | 33 | 8.2 | 1.0 | 0.3 | 14.9 | 72.7 | 11.0 |
|  | 54 | 12.7 | 1.0 | 0.5 | 24.0 | 67.1 | 7.4 |
| TAG-sn1,3 | 33 | 8.2 | 26.8 | 7.0 | 23.8 | 34.9 | 7.5 |
| (Calculated) | 54 | 12.7 | 17.3 | 8.5 | 49.1 | 22.0 | 3.2 |

Changes in fatty acid profiles associated with YL DGAT expression observed in TAG are also observed in polar lipids.

Example 16

Yarrowia DGAT Variants with Altered Amino Acid Sequence

The present example describes the creation of mutant forms of Yarrowia DGAT2, cloning them into a yeast expression vector and assaying microsomal protein fractions for DGAT activity.

Constructing Saccharomyces expression vectors containing mutant Yarrowia DGAT2s

Yarrowia DGAT2 was amplified from pKR1234 (SEQ ID NO:68; Example 14) with oligonucleotide primers oYDG2-1 (SEQ ID NO:76) and oYDG2-2 (SEQ ID NO:77), using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1254 (SEQ ID NO:78).

A single codon in the Yarrowia DGAT2 sequence, which codes for amino acid Y326 in the corresponding amino acid sequence SEQ ID NO:10, was changed using the Quickchange® Site Directed Mutagenesis kit (Cat. No. 200518, Stratagene, La Jolla, Calif.), with oligonucleotides YID2_Y326F-5 (SEQ ID NO:79) and YID2_Y326F-3 (SEQ ID NO:80), following the manufacturer's protocol. After extensive sequencing, a clone coding for an amino acid sequence which is identical to the Yarrowia DGAT2 (SEQ ID NO:10), except that Y326 was changed to F326, was chosen for further study. This clone was designated pKR1254_Y326F (SEQ ID NO:81). The nucleotide sequence for altered coding sequence (YIDGAT2_Y326F) is set forth in SEQ ID NO:82 and the corresponding amino acid sequence is set forth in SEQ ID NO:83.

A single codon in the Yarrowia DGAT2 sequence, which codes for amino acid Y326 in the corresponding amino acid sequence SEQ ID NO:10, was changed using the Quickchange® Site Directed Mutagenesis kit (Cat. No. 200518, Stratagene, La Jolla, Calif.), with oligonucleotides YID2_Y326L-5 (SEQ ID NO:84) and YID2_Y326L-3 (SEQ ID NO:85), following the manufacturer's protocol. After extensive sequencing, a clone coding for an amino acid sequence which is identical to the Yarrowia DGAT2 (SEQ ID NO:10), except that Y326 was changed to L326, was chosen for further study. This clone was designated pKR1254_Y326L (SEQ ID NO:86). The nucleotide sequence for altered coding sequence (YIDGAT2_Y326L) is set forth in SEQ ID NO:87 and the corresponding amino acid sequence is set forth in SEQ ID NO:88.

A single codon in the *Yarrowia* DGAT2 sequence, which codes for amino acid R327 in the corresponding amino acid sequence SEQ ID NO:10, was changed using the Quickchange® Site Directed Mutagenesis kit (Cat. No. 200518, Stratagene, La Jolla, Calif.), with oligonucleotides YID2_R327K-5 (SEQ ID NO:89) and YID2_R327K-3 (SEQ ID NO:90), following the manufacturer's protocol. After extensive sequencing, a clone coding for an amino acid sequence which is identical to the *Yarrowia* DGAT2 (SEQ ID NO:10), except that R327 was changed to K327, was chosen for further study. This clone was designated pKR1254_R327K (SEQ ID NO:91). The nucleotide sequence for altered coding sequence (YIDGAT2_Y326L) is set forth in SEQ ID NO:92 and the corresponding amino acid sequence is set forth in SEQ ID NO:93.

The NotI fragments of pKR1254, pKR1254_Y326F, pKR1254_Y326L or pKR1254_R327K, each containing a wild-type or mutant version of YIDGAT2, were cloned into the NotI site of pY75 (SEQ ID NO:3; Example 1) to produce pY191 (SEQ ID NO:94), pY192 (SEQ ID NO:95), pY193 (SEQ ID NO:96) or pY194 (SEQ ID NO:97), respectively.

Assaying DGAT Activity of Mutant *Yarrowia* DGAT2s

A mutant strain of *Saccharomyces cerevisiae* where the endogenous DGAT2 gene (DGA1) was knocked out and has the follwing genotype (BY4741, MATa his3Δ1 leu2Δ0 met15Δ0 ura3Δ0) was obtained from Open Biosystems (http://www.openbiosystems.com/). It was transformed with pY191, pY192, pY193 or pY194 and transformants were isolated as described herein. Three individual transformants per transformation were inoculated into 2 mL cultures of DOBA media supplemented with CSM-leu 30° C. for 16 h. Cells (1 mL) were transferred to 50 mL of DOBA medium described above and grown at 30° C. for an additional 16 h. Cells were pelleted by centrifugation, frozen in liquid nitrogen and stored at −80° C. until required for use.

Pellets were re-suspended in 2 mL of yeast homogenization buffer (20 mM Tris.HCl, pH 8.0; 10 mM MgCl2; 1 mM EDTA; 5% glycerol; 1 mM DTT; 0.3 M $(NH_4)_2SO_4$) and the suspension was added to a 2 mL screw cap tube containing approximately 1 mL of 0.5 mm glass beads. The after removal of air pockets by vortexing, the resuspension was filled to the top of the tube, the tube capped and the cells broken with three, 1 min. pulses in a mini bead beater at 5000 rpm with storage on ice for 5 min. The yeast homogenate was centrifuged at 1,500×g for 15 min. at 4 C and the resulting supernatant was then centrifuged at 100,000×g for 60 min. The resulting pellet was responded in approximately 0.2 to 0.5 mL of microsome buffer (100 mM potassium phosphate, pH 7.2) by gentle pipetting followed by further resuspension in a 2 mL sized Teflon-coated Dounce homogenizer. Protein concentrations were determine using Bradford reagent (Sigma-Aldrich) and microsomes were snap frozen in liquid nitrogen and stored at −80 C until assayed.

DGAT assays were carried out for 1 min at 25° C. in yeast assay buffer (50 mM potassium phosphate (pH 7.2)), with 20 µM 1-14C-labeled oleoyl-coenzyme A (50 mCi/mmol, Perkin Elmer), and 20 pg of microsomal protein in a total reaction volume of 100 µl. Each reaction was initiated by addition of the microsomal membranes to the remainder of the reaction components. Assays were terminated and radioactivity into TAG determined exactly as described for the plant DGAT assays except the formula was changed to reflect a 1 min. assay time (i.e. [dpm]/[2200000 dpm/uCi]/[50 uCi/umol]/[5 min.]/[0.02 mg protein]×[1000 nmol/umol]). DGAT activities for each of the samples as well as the averages described are shown in Table 31.

TABLE 31

DGAT activities for DGA1 Transformed with pY191, pY192, pY193 or pY194.

| Plasmid | Mutant | DGAT Activity (nmol · min⁻¹ · mg⁻¹) | Avg. DGAT Activity (nmol · min⁻¹ · mg⁻¹) | Std. Dev. |
|---|---|---|---|---|
| pY191 | wt | 7.6 | 10.4 | 2.7 |
|  |  | 10.6 |  |  |
|  |  | 13.0 |  |  |
| pY192 | Y326F | 6.5 | 8.3 | 1.7 |
|  |  | 8.4 |  |  |
|  |  | 10.0 |  |  |
| pY193 | Y326L | 6.2 | 8.1 | 1.9 |
|  |  | 10.0 |  |  |
|  |  | 8.2 |  |  |
| pY194 | R327K | 5.9 | 6.2 | 0.4 |
|  |  | 6.0 |  |  |
|  |  | 6.7 |  |  |

From Table 31, it appears that the Y326F and Y326L amino acid changes have minimal effect on *Yarrowia* DGAT2 activity when assayed in yeast and these two mutants were chosen for expression in soy somatic embryos.

Constructing Soy Expression Vectors Containing Mutant *Yarrowia* DGAT2s

The NotI fragment of pKR1254 (SEQ ID NO:78), pKR1254_Y326F (SEQ ID NO:81) or pKR1254-Y326L (SEQ ID NO:86), containing wild-type or mutant forms of *Yarrowia* DGAT2, were cloned into the NotI fragment of pKR72 (SEQ ID NO:26; Example 4) to produce pKR1256 (SEQ ID NO:98), pKR1277 (SEQ ID NO:99) or pKR1278 (SEQ ID NO:100), respectively.

Determining Oil Concentrations of Soy Somatic Embryos Expressing Mutant *Yarrowia* DGAT2s Soybean embryogenic suspension culture (cv. Jack) was transformed with either pKR1256 (SEQ ID NO:98), comprising wild-type *Yarrowia* DGAT2 and having experiment number MSE2228, pKR1277 (SEQ ID NO:99), comprising *Yarrowia* DGAT2_Y326F and having experiment number MSE2229, or pKR1278 (SEQ ID NO:100), comprising *Yarrowia* DGAT2_Y326L and having experiment number MSE2230. Events were selected and somatic embryos matured in SHaM as described in Example 5. Oil concentrations were determined for each event using the NMR and described herein and fatty acid profiles were determined by GC exactly as described in herein and results for oil concentrations and oleic acid content (% of total FAME) are shown in Table 32

TABLE 32

Oil concentrations for somatic soy embryos transformed with pKR1256, pKR1277 or pKR1278

| MSE2228-pKR1256 (wt DGAT2) | | | MSE2229-pKR1277 (Y326F) | | | MSE2230-pKR1278 (Y326L) | | |
|---|---|---|---|---|---|---|---|---|
| Event # | FAME (% DCW) | oleic acid (% total FAME) | Event # | FAME (% DCW) | oleic acid (% total FAME) | Event # | FAME (% DCW) | oleic acid (% total FAME) |
| 2228-9 | 14.3 | 44.4 | 2229-6 | 15.1 | 43.5 | 2230-4 | 11.6 | 35.1 |
| 2228-20 | 12.6 | 34.3 | 2229-20 | 14.4 | 44.3 | 2230-21 | 10.1 | 22.3 |
| 2228-3 | 12.4 | 39.3 | 2229-13 | 14.4 | 38.1 | 2230-15 | 9.8 | 22.4 |
| 2228-14 | 12.3 | 36.8 | 2229-21 | 14.0 | 36.5 | 2230-8 | 9.7 | 34.9 |
| 2228-2 | 11.7 | 36.8 | 2229-16 | 13.2 | 36.3 | 2230-29 | 9.6 | 33.0 |
| 2228-15 | 10.9 | 35.2 | 2229-24 | 13.1 | 39.9 | 2230-27 | 9.4 | 35.6 |
| 2228-5 | 10.1 | 23.3 | 2229-23 | 12.3 | 42.7 | 2230-3 | 9.4 | 36.7 |
| 2228-17 | 10.0 | 23.5 | 2229-3 | 12.2 | 41.3 | 2230-19 | 9.0 | 34.7 |
| 2228-24 | 10.0 | 27.6 | 2229-25 | 12.0 | 40.4 | 2230-6 | 8.6 | 23.6 |
| 2228-6 | 9.5 | 25.2 | 2229-31 | 11.9 | 39.0 | 2230-24 | 8.5 | 25.3 |
| 2228-18 | 9.5 | 32.4 | 2229-18 | 11.6 | 40.8 | 2230-18 | 8.4 | 35.8 |
| 2228-21 | 9.0 | 32.9 | 2229-5 | 11.4 | 38.7 | 2230-22 | 7.3 | 23.3 |
| 2228-12 | 8.7 | 22.7 | 2229-12 | 11.3 | 36.7 | 2230-2 | 7.0 | 26.7 |
| 2228-10 | 8.4 | 24.3 | 2229-10 | 11.3 | 35.6 | 2230-14 | 6.9 | 25.9 |
| 2228-22 | 7.5 | 29.9 | 2229-27 | 10.9 | 27.8 | 2230-9 | 6.9 | 22.9 |
| 2228-8 | 6.8 | 21.4 | 2229-30 | 10.7 | 39.0 | 2230-25 | 6.8 | 27.3 |
| 2228-19 | 6.5 | 27.3 | 2229-15 | 10.4 | 36.3 | 2230-7 | 6.8 | 37.5 |
| 2228-23 | 6.4 | 26.5 | 2229-8 | 9.7 | 39.5 | 2230-5 | 6.5 | 25.6 |
| 2228-7 | 6.1 | 22.2 | 2229-9 | 9.4 | 37.4 | 2230-10 | 6.4 | 31.1 |
| 2228-13 | 6.1 | 24.0 | 2229-22 | 9.2 | 22.3 | 2230-30 | 6.3 | 24.7 |
| 2228-11 | 5.2 | 24.3 | 2229-7 | 8.7 | 23.0 | 2230-26 | 6.3 | 23.4 |
| 2228-4 | 5.1 | 18.5 | 2229-26 | 8.4 | 31.2 | 2230-17 | 6.3 | 25.2 |
| 2228-16 | 4.2 | 19.3 | 2229-17 | 8.3 | 38.2 | 2230-20 | 6.3 | 19.5 |
| 2228-1 | 3.2 | 23.1 | 2229-28 | 7.9 | 27.2 | 2230-13 | 5.8 | 22.3 |
| average | 8.6 | 28.1 | 2229-29 | 7.8 | 25.7 | 2230-12 | 5.7 | 21.7 |
| | | | 2229-1 | 7.4 | 32.8 | 2230-23 | 5.6 | 25.1 |
| | | | 2229-2 | 5.9 | 18.6 | 2230-11 | 5.5 | 20.7 |
| | | | 2229-11 | 4.6 | 18.6 | 2230-1 | 5.4 | 26.3 |
| | | | 2229-19 | 4.1 | 22.6 | 2230-16 | 5.3 | 24.0 |
| | | | 2229-4 | 4.0 | 21.2 | 2230-28 | 4.6 | 20.4 |
| | | | 2229-14 | 3.1 | 39.8 | 2230-31 | 4.3 | 18.3 |
| | | | average | 8.8 | 32.2 | average | 6.5 | 25.4 |

In soy somatic embryos, a variant of the YL DGAT2 protein carrying the Y326F mutation increases oil concentrations and shifts the fatty acid profile of the oil at least to the same extent as the wild-type *Yarrowia* DGAT2.

Example 17

Expression Optimized DGAT Genes

Sequences encoding YL DGAT1 and YL DGAT2 genes that are optimized for expression in soybean plants are set forth as SEQ ID NO:64 and SEQ ID NO:66. The design of these sequences is described in Example 9. DNA molecules with this DNA sequence flanked by Not I restriction sites were synthesized by DNA 2.0 (California, USA). Plasmid DNA with the synthesized genes was digested with Not I. Not I restriction fragments with the DGAT genes were ligated to Not linearized, dephosphorylated DNA of KS332, which is described in Example 5. The resulting DNA constructs in which expression of expression-optimized variants of *Yarrowia* DGAT1 or *Yarrowia* DGAT2 genes are under the control of the betaconglycinin promoter are henceforth referred to as KS392 and KS393. Their sequence is set forth as SEQ ID NO:101 and SEQ ID NO:102. Moreover plasmid KS391 was constructed. To this end DNA of KS349 was digested with NotI and NcoI. Ends of the of the resulting DGAT1 restriction fragment were completely filled-in and ligated to NotI linearized and filled in DNA of KS332. The resulting plasmid construct is henceforth referred to as KS391. In this construct the native YL DGAT1 sequences is under the control of the betaconglycinin promoter. The sequence of KS391 is set forth as SEQ ID NO:103. Transgenic soybean somatic embryos were regenerated as after particle bombardment with plasmid DNA of KS391, KS392, KS 362 and KS393 as described above (Example 5). Oil content of somatic embryos was measured using NMR. Briefly lyophilized embryo tissue was pulverized in genogrnder vial as described previously (Example 4). 20-200 mg of tissue powder were transferred to NMR tubes. Oil content of the somatic embryo tissue powder was calculated from the NMR signal as described in Example 4.

TABLE 33

Oil concentrations for somatic soy embryos transformed with pKS392 and pKS391

| Construct KS392 | | | Construct KS391 | | |
|---|---|---|---|---|---|
| SAMPLE | ID | % oil | SAMPLE | ID | % oil |
| 1 | 2196.1.08 | 15.7 | 1 | 2195.3.15 | 12.8 |
| 2 | 2196.3.03 | 13.9 | 2 | 2195.5.02 | 11.5 |
| 3 | 2196.1.05 | 13.7 | 3 | 2195.3.01 | 11.2 |
| 4 | 2196.1.15 | 13.4 | 4 | 2195.3.03 | 11.0 |
| 5 | 2196.1.02 | 12.2 | 5 | 2195.3.02 | 10.6 |
| 6 | 2196.3.07 | 12.1 | 6 | 2195.4.06 | 10.4 |
| 7 | 2196.3.04 | 12.1 | 7 | 2195.3.08 | 10.2 |

TABLE 33-continued

Oil concentrations for somatic soy embryos transformed with pKS392 and pKS391

| Construct KS392 | | | Construct KS391 | | |
|---|---|---|---|---|---|
| SAMPLE | ID | % oil | SAMPLE | ID | % oil |
| 8 | 2196.3.05 | 11.6 | 8 | 2195.2.01 | 10.1 |
| 9 | 2196.1.06 | 11.4 | 9 | 2195.3.04 | 9.3 |
| 10 | 2196.1.07 | 11.4 | 10 | 2195.3.05 | 9.2 |
| 11 | 2196.1.03 | 10.4 | 11 | 2195.5.01 | 9.1 |
| 12 | 2196.1.14 | 10.2 | 12 | 2195.2.04 | 8.8 |
| 13 | 2196.1.12 | 9.4 | 13 | 2195.3.14 | 8.6 |
| 14 | 2196.3.08 | 9.1 | 14 | 2195.3.10 | 7.8 |
| 15 | 2196.3.09 | 8.1 | 15 | 2195.4.01 | 7.7 |
| 16 | 2196.4.02 | 8.1 | 16 | 2195.5.03 | 6.5 |
| 17 | 2196.1.09 | 7.8 | 17 | 2195.4.02 | 6.4 |
| 18 | 2196.2.01 | 7.6 | 18 | 2195.3.09 | 6.3 |
| 19 | 2196.5.01 | 7.4 | 19 | 2195.4.07 | 6.2 |
| 20 | 2196.3.01 | 7.4 | 20 | 2195.3.06 | 6.1 |
| 21 | 2196.1.04 | 7.3 | 21 | 2195.3.13 | 6.0 |
| 22 | 2196.2.02 | 7.3 | 22 | 2195.5.05 | 5.9 |
| 23 | 2196.3.02 | 6.9 | 23 | 2195.4.03 | 5.6 |
| 24 | 2196.1.10 | 6.5 | 24 | 2195.5.04 | 5.5 |
| 25 | 2196.4.03 | 6.5 | 25 | 2196.1.01 | 5.3 |
| 26 | 2196.1.11 | 6.0 | 26 | 2195.4.04 | 5.3 |
| 27 | 2196.4.01 | 5.7 | 27 | 2195.3.11 | 5.2 |
| 28 | 2196.3.06 | 5.4 | 28 | 2195.2.03 | 5.0 |
| 29 | 2196.5.02 | 5.3 | 29 | 2195.4.05 | 4.9 |
| 30 | 2196.1.13 | 3.5 | 30 | 2195.3.07 | 4.4 |
| | AVERAGE % OIL | 9.1 | 31 | 2195.2.02 | 4.3 |
| | | | | AVERAGE % OIL | 7.6 |

Table 33 compares the oil content of 30 and 31 events generated with KS392 and KS 391, respectively. Average oil content of all events generated with KS392 was 9.1% whereas oil content of all events generated with KS391 was 7.6%. More over the highest oil content observed with KS392 was 15.7% compared to 12.8% for KS391. Applicants have demonstrated that expression optimization of YL DGAT1 leads to increased oil content in developing soybean embryos when compared to the native YL DGAT1 gene.

TABLE 34

Oil concentrations for somatic soy embryos transformed with pKS393 and pKS362

| Construct KS393 | | | Construct KS362 | | |
|---|---|---|---|---|---|
| SAMPLE | ID | % oil | SAMPLE | ID | % oil |
| 1 | 2207.5.05 | 12.3 | 1 | 2208.2.08 | 11.6 |
| 2 | 2207.5.08 | 12.2 | 2 | 2208.5.04 | 11.5 |
| 3 | 2207.5.06 | 11.7 | 3 | 2208.2.04 | 11.5 |
| 4 | 2207.5.03 | 10.8 | 4 | 2208.2.10 | 11.2 |
| 5 | 2207.5.01 | 10.6 | 5 | 2208.2.09 | 10.3 |
| 6 | 2207.5.04 | 10.3 | 6 | 2208.2.02 | 10.2 |
| 7 | 2207.4.04 | 10.3 | 7 | 2208.5.02 | 10.0 |
| 8 | 2207.3.09 | 9.5 | 8 | 2208.3.10 | 9.8 |
| 9 | 2207.5.07 | 9.3 | 9 | 2208.3.12 | 9.8 |
| 10 | 2207.4.01 | 8.8 | 10 | 2208.3.06 | 9.5 |
| 11 | 2207.4.02 | 8.7 | 11 | 2208.3.04 | 8.8 |
| 12 | 2207.3.06 | 8.0 | 12 | 2208.5.05 | 8.6 |
| 13 | 2207.3.04 | 7.9 | 13 | 2208.2.07 | 8.1 |
| 14 | 2207.4.06 | 7.8 | 14 | 2208.2.03 | 8.0 |
| 15 | 2207.4.03 | 7.7 | 15 | 2208.3.03 | 8.0 |
| 16 | 2207.4.08 | 7.4 | 16 | 2208.5.01 | 8.0 |
| 17 | 2207.3.14 | 7.1 | 17 | 2208.2.06 | 7.8 |
| 18 | 2207.4.05 | 7.0 | 18 | 2208.2.11 | 7.4 |
| 19 | 2207.3.12 | 7.0 | 19 | 2208.5.07 | 7.3 |
| 20 | 2207.3.01 | 6.9 | 20 | 2208.3.14 | 7.2 |
| 21 | 2207.5.02 | 6.8 | 21 | 2208.3.02 | 7.0 |
| 22 | 2207.3.02 | 6.7 | 22 | 2208.3.08 | 6.4 |

TABLE 34-continued

Oil concentrations for somatic soy embryos transformed with pKS393 and pKS362

| Construct KS393 | | | Construct KS362 | | |
|---|---|---|---|---|---|
| SAMPLE | ID | % oil | SAMPLE | ID | % oil |
| 23 | 2207.3.07 | 6.7 | 23 | 2208.3.07 | 6.1 |
| 24 | 2207.3.03 | 6.6 | 24 | 2208.2.12 | 6.1 |
| 25 | 2207.3.13 | 6.5 | 25 | 2208.3.09 | 6.0 |
| 26 | 2207.3.11 | 6.3 | 26 | 2208.3.11 | 6.0 |
| 27 | 2207.3.05 | 5.8 | 27 | 2208.2.01 | 5.8 |
| 28 | 2207.3.10 | 5.8 | 28 | 2208.2.05 | 5.7 |
| 29 | 2207.4.07 | 5.5 | 29 | 2208.3.01 | 5.4 |
| 30 | 2207.3.08 | 5.4 | 30 | 2208.5.03 | 5.1 |
| 31 | 2207.4.09 | 5.4 | 31 | 2208.3.13 | 4.7 |
| | AVERAGE % OIL | 8.0 | 32 | 2208.5.06 | 4.1 |
| | | | 33 | 2208.3.05 | 3.2 |
| | | | | AVERAGE % OIL | 7.8 |

Table 34 compares the oil content 31 of and 33 events generated with KS393 and KS 362. Average oil content of all events generated with KS393 was 8.0% whereas oil content of all events generated with KS393 was 7.8%. More over the highest oil content observed with KS393 was 12.3% compared to 11.6% for KS362. Applicants have demonstrated that expression optimization of YL DGAT2 leads a very small increase in oil content in developing soybean embryos when compared to the native YL DGAT2 gene.

Example 18

Cloning and Sequencing of DGAT2 from *Toruloslora delbrueckii*

Isolation of *Torulospora delbrueckii* from a Cured Meat Sample

A Sopressata sausage was purchased from a local grocery store. A small portion of the sausage, approximately 10 grams, was homogenized in a sterile solution of 0.1% Triton-X 100 using a Waring blender. Glycerol was added to the sausage suspension to a final concentration of 15% (w/w). Serial dilutions of the sausage suspension were plated on solid media prepared using premade Yeast Morphology Agar medium (HiMedia Laboratories, India) containing 150 mg $L^{-1}$ of chloramphenicol. Plates were incubated at room temperature for one week. Individual colonies were re-streaked on media with identical composition with the exception that magenta-glucuro.CHA (Bromo-6-chloro-3-indolyl-β-D-glucuronide cyclohexylammonium salt (Sigma, USA)) was added to the medium at a concentration of 200 mg $L^{-1}$.

Several yeast isolates did not produce dark-violet colonies when streaked on media containing magenta-glucuro.CHA. According to M. Quiros et al (Journal of Food Protection (2005), 68(4), 808-814) this calorimetric reaction provides reliable means for identification of Debaryomyces hansenii.

Genomic DNA Isolation and Ribosomal DNA Sequencing

A liquid culture (50 mL YPD medium) of a magenta-glucuro.CHA-negative yeast strain was grown at 28° C. for 72 h, at 250 rpm. Yeast cells were collected by centrifugation and washed in deionized water. Yeast cells were resuspended in 2 mL of STE buffer (0.1 M sorbitol, 10 mM Tris/HCl, pH 7.5, 1 mM EDTA) containing 10 mg $mL^{-1}$ of Zymolase (Zymo Research Corporation, California, USA) and incubated for 2 hours at 37° C. Total genomic DNA was isolated from Yeast spheroplasts as follows. The yeast suspension was lysed in 4 mL of Urea Extraction buffer (0.3125 M NaCl, 50 mM Tris HCl, pH 8.0, 20 mM EDTA, 1% sarkosine) and equal volume of phenol/chloroform was added followed by thorough mixing. After centrifugation the aqueous phase was re-extracted with phenol chloroform. Nucleic acids were precipitated by addition of 1/8 volume of 4.4 M sodium acetate and 1 volume of isopropanol followed by centrifugation. Nucleic acid were dried and resuspended in 500 microL TE (10 mM Tris, 1 mM EDTA). A small aliquot (1 microL) of the nucleic acid solution was separated on 0.4% agarose gels next to molecular weight marker to confirm that molecular weight was ≧50 kb.

TABLE 35

Oligonucleotide primers for amplification of a 26S ribosomal DNA sequence from ascomycete yeast

| name | comment | sequence | SEQ ID NO: |
|---|---|---|---|
| MWG619 | 26s FWD | GCATATCAATAAGCGGAGGAAAAG | 104 |
| MWG620 | 26s REV | GGTCCGTGTTTCAAGACGG | 105 |

A 26S ribosomal gene fragment was generated by PCR as follows. The PCR reaction contained 50 mM KCl, 10 mM Tris-HCl (pH 9), 0.1% Triton X-100, 2.5 mM MgCl$_2$, 0.2 mM each dNTP, 5 units of Taq polymerase (MBI Fermentas, USA), 100 ng of genomic DNA of the magenta-glucuro.CHA-negative yeast strain and PCR primers MWG619 (SEQ ID NO:104) and MWG620 (SEQ ID NO:105) at a final concentration of 1 µM. Amplification was carried out for 35 cycles, each comprising 45 sec at 94° C., 45 sec at 55° C., and 1 min at 72° C. A PCR product of approximately 600 bp was excised from agarose gels and sequenced directly using the primers MWG619 and MWG620. A BLASTN search against NT (Public DNA from NCBI) was conducted using the resulting DNA sequence. As shown in Table 36 the sequence was found to be 99% identical to various entries of 26s ribosomal sequences derived from *Torulaspora delbrueckii*. The 26s ribosomal DNA fragment of the *Torulaspora delbrueckii* yeast strain isolated by applicants from a cured meat sample is set forth as SEQ ID NO:106.

TABLE 36

BLASTN results generated with the sequence of a magenta-glucuro.CHA-negative yeast strain derived from cured meat

| Ranking | Sequence info | Blast score |
|---|---|---|
| 1 | >gi\|169125895\|gb\|EU441895.1\| *Torulaspora delbrueckii* strain B-5(3) 26S ribosomal RNA gene, partial sequence Length = 613 | Score = 1082 bits (546), Expect = 0.0 Identities = 560/562 (99%), Gaps = 2/562 (0%) Strand = Plus/Minus |
| 2 | >gi\|117573753\|gb\|EF063125.1\|*Torulaspora delbrueckii* strain EXOC35 26S ribosomal RNA gene, partial sequence | Score = 1082 bits (546), Expect = 0.0 Identities = 560/562 (99%), Gaps = 2/562 (0%) Strand = Plus/Minus |

Generation of DGAT2 Specific Probe Using PCR

A DGAT2 gene fragment was generated by PCR as follows. The PCR reaction contained 50 mM KCl, 10 mM Tris-HCl (pH 9), 0.1% Triton X-100, 2.5 mM MgCl$_2$, 0.2 mM each dNTP, 5 units of Taq polymerase (MBI Fermentas, USA), 100 ng of genomic DNA of *Torulaspora delbrueckii* and PCR primers P7 (SEQ ID NO:107) and P8 (SEQ ID NO:108) at a final concentration of 1 µM. Amplification was carried out for 35 cycles, each comprising 45 sec at 94° C., 45 sec at 52° C., and 1 min at 72° C. A PCR product of approximately 270 bp was excised from agarose gels, cloned and sequenced using standard techniques. One plasmid clones were identified that contained a cloned PCR product of 263 bp. The nucleotide and deduced amino acid sequence of this PCR product are set forth as SEQ ID NO:121 and SEQ ID NO:122. A BLASTP search of the annotated fungal protein database at NCBI was conducted. The deduced amino acid sequence of the PCR product shares 79.5% sequence identity to an unnamed protein product from *Candida glabrata* with GENBANK accession number XP_447864 which represents the protein with the closest similarity in this database. The deduced amino acid sequence of this PCR product also shares 75.9% sequence identity to Dga1 of *Saccharomyces cerevisiae* with GENBANK accession number NP_014888.

TABLE 37

Degenerate oligonucleotide primers used for amplification of DGAT genes from oleaginous yeast and fungi

| gene | oligonucleotide primer name | degenerate oligonucleotide sequence |
|---|---|---|
| DGAT2 | P7 (29mer) | AACTACATCTTCGGCTAYCAYCCNCAYGG (SEQ ID NO: 107) |
| | P8 (29mer) | AGGGACTCGGAGGCGCCGCCNCANACDAT (SEQ ID NO: 108) |
| | P7i (29mer) | AACTACATCTTCGGCTAYCAYCCXCAYGG (SEQ ID NO: 109) |
| | P8i (29mer) | AGGGACTCGGAGGCGCCGCCXCAXACDAT (SEQ ID NO: 110) |
| | BM DGAT2 fwd (41mer) | CCXCCXAAYMGXCCXTAYYTXTTYGGXTAYCAYCCXCAYGG (SEQ ID NO: 111) |
| | BM DGAT2 rev (40mer) | CRTTYTCXCCRAAXSWRAAXACXGGXACXARRTCXGCXCC (SEQ ID NO: 112) |
| DGAT1 | fwd (37mer) | GGTGGGCXCCXACXYTXGTXTAYCARCCXGTXTAYCC (SEQ ID NO: 113) |
| | rev (41mer) | CCDATDATRTTRTGXGTXGGXACXCCXACXARXARYTCRTG (SEQ ID NO: 114) |

| | | corresponding amino acid sequence |
|---|---|---|
| DGAT2 | P7 (29mer) | NYIFGYHPHG (SEQ ID NO: 115) |
| | P8 (29mer) | IVVGGASESL (SEQ ID NO: 116) |
| | P7i (29mer) | NYIFGYHPHG (SEQ ID NO: 115) |
| | P8i (29mer) | IVVGGASESL (SEQ ID NO: 116) |
| | BM DGAT2 fwd (41mer) | PPNXPYXFGYHPH (SEQ ID NO: 117) |
| | BM DGAT2 rev (40mer) | GADXVPVFXFGEN (SEQ ID NO: 118) |
| DGAT1 | fwd (37mer) | WWAPTLVYQPVYP (SEQ ID NO: 119) |
| | rev (41mer) | HELLVGVPTHNIIG (SEQ ID NO: 120) |

Symbol (Meaning): R (G or A), Y (T or C), M (A or C), K (G or T), S (G or C), W (A or T), H (A or C or T), B (G or T or C), V (G or C or A), D (G or A or T), N (G or A or T or C), and X (Inosine)

Cosmid Library Construction, Screening and Sequencing of a DGAT2 Gene

Genomic DNA of Torulaspora delbrueckii was partially digested with MboI. Briefly, approximately 10 µg of genomic DNA were digested with 0.5 units of MboI (NEB, USA) in a final volume of 100 µL in the presence of 0.1 mg mL$^{-1}$ BSA, and 0.1 mg mL$^{-1}$ DNAse-free RNAse (Quiagen, USA) 100 mM NaCl, 50 mM Tris-HCl, 10 mM MgCl$_2$, 1 mM DTT, pH 7.9. Aliquots of 25 µL were removed after 30, 60, 120 and 180 seconds respectively and combined in a tube that contained 5 µL of 500 mM EDTA. The partially digested DNA was purified and concentrated to a final volume of 10 µL using DNA Clean and Concentrator™ spin columns (Zymoresearch, USA) according to instructions of the manufacturer. The DNA was ligated to 2 µg of linearized pLAFR3DNA (B. Staskawicz et al., Journal of bacteriology (1987), 169(12), 5789-94) that had been completely digested with BamHI and dephosphorylated with Antarctic Phosphatase (NEB, USA). The ligation reaction was invitro-packaged and transfected into E. coli cells of strain NM554 (Stratagene, USA) using MAXPLAX packaging extracts (EPICENTRE Biotechnologies, USA) according to instructions of the manufacturer. Transfected cells were added to 15 mL of LB medium, incubated at 37° C. on Lab shaker set to 250 rpm. Glycerol was added to a final concentration of 15% (w/w) and the cell suspension was frozen using a dry ice methanol mixture. The titer of the cosmid library was determined by plating serial dilutions of the thawed cell suspension on sol id ified LB med ium contain ing 10 mg L$^{-1}$ of tetracycline. Approximately 20,000 cosmid clones were plated on selective media, transferred to Biodyne B membranes (PALL Corporation, USA) and screened with a $^{32}$P labeled probe corresponding to the cloned PCR product derived from Torulaspora delbrueckii (SEQ ID NO:121) according to stardard protocols. Cesium chloride density gradient centrifugation was used as described in T. Maniatis et al. Molecular Cloning: A Laboratory Manual. (1982), 545 pp., was used to purify cosmid DNA from liquid cultures derived from colonies that hybridized to the probe under stringent conditions. Five cosmid clones were sequenced using eight primers with SEQ ID NOs: 123 through 130 (Table 38). Sequences were assembled using the SEQMAN program of the LASERGENE™ 7.1.1 software package (DNASTAR, INC., USA). DNA sequencing of five independently isolated cosmids with said primers produced DNA sequences that could be assembled into two closely related sequences. The consensus sequences derived from this effort are referred to as TD_DGAT2A gene and TD_DGAT2B gene and are set forth as SEQ ID NO:131 and SEQ ID NO:132. TD_DGAT2A gene and TD_DGAT2B gene are genomic sequences of 2700 bp that contain ORFs TD_DGAT2A (SEQ ID NO:133) and TD_DGAT2B (SEQ ID NO:134) that each comprise 1362 bp of sequence encoding closely related proteins TD_DGAT2A (SEQ ID NO:135) and TD_DGAT2B (SEQ ID NO:136) that are both comprised of 453 amino acids. Nucleotide and deduced amino acid sequence of TD_DGAT2A and TD_DGAT2B share 95% and 96.9% sequence identity in CLUSTALW alignments. The deduced amino acid sequence TD_DGAT2A and TD_DGAT2B share 57.4 and 56% sequence identity, respectively in a CLUSTALW alignment to an unnamed protein product from *Candida glabrata* with GENBANK accession number XP_447864 which represents the protein with the closest similarity to said genes from *Torulaspora delbrueckii* in this database. The deduced amino acid sequences of TD_DAGT2A and TD_DGAT2B also share 57.3 and 57% sequence identity, respectively to Dga1 of *Saccharomyces cerevisiae* with GENBANK accession number NP_014888.

TABLE 38

Primers used for sequencing of cosmid clones derived from *Torulaspora delbrueckii*

| Name | Sequence | SEQ ID NO: |
|---|---|---|
| MWG 625 | CCATTGGTACTGAAGGTTGTGGCTGGTCC | 123 |
| MWG 626 | GGACCAGCCACAACCTTCAGTACCAATGG | 124 |
| MWG 627 | GTCCCATTGTACAGGGATTACTTATTGGCG | 125 |
| MWG 628 | CGCCAATAAGTAATCCCTGTACAATGGGAC | 126 |
| MWG 637 | CCCTCATTATGGGCTTCCTAGGTTAG | 127 |
| MWG 638 | CTAACCTAGGAAGCCCATAATGAGGG | 128 |
| MWG 639 | CCAAACCCAACACAGGAACAAGTAGATC | 129 |
| MWG 640 | GATCTACTTGTTCCTGTGTTGGGTTTGG | 130 |

Example 19

Cloning and Sequencing of DGAT2 from *Pichia anomala*

Isolation of *Pichia anomala* from a Cured Meat Sample

A Sopressata sausage was purchased from a local grocery store. A small portion of the sausage, approximately 10 grams, was homogenized in a sterile solution of 0.1% Triton-X 100 using a Waring blender. Glycerol was added to the sausage suspension to a final concentration of 15% (w/w). Serial dilutions of the sausage suspension were plated on solid media prepared using premade Yeast Morphology Agar medium (HiMedia Laboratories, India) containing 150 mg $L^{-1}$ of chloramphenicol. Plates were incubated at room temperature for one week. Individual colonies were re-streaked on media with identical composition with the exception that magenta-glucuro.CHA (Bromo-6-chloro-3-indolyl-β-D-glucuronide cyclohexylammonium salt (Sigma, USA)) was added to the medium at a concentration of 200 mg $L^{-1}$.

Several yeast isolates did not produce dark-violet colonies when streaked on media containing magenta-glucuro.CHA. According to M. Quiros et al (Journal of Food Protection (2005), 68(4), 808-814) this colorimetric reaction provides reliable means for identification of *Debaryomyces hansenii*.

Genomic DNA Isolation and Ribosomal DNA Sequencing

A liquid culture (50 mL YPD medium) of a second magenta-glucuro.CHA-negative yeast strain was grown at 28° C. for 72 h, at 250 rpm. Yeast cells were collected by centrifugation and washed in deionized water. Yeast cells were resuspended in 2 mL of STE buffer (0.1 M sorbitol, 10 mM Tris/HCl, pH 7.5, 1 mM EDTA) containing 10 mg $mL^{-1}$ of Zymolase (Zymo Research Corporation, California, USA) and incubated for 2 hours at 37° C. Total genomic DNA was isolated from Yeast spheroplasts as follows. The yeast suspension was lysed in 4 mL of Urea Extraction buffer (0.3125 M NaCl, 50 mM Tris HCl, pH 8.0, 20 mM EDTA, 1% sarkosine) and equal volume of phenol /chloroform was added followed by thorough mixing. After centrifugation the aqueous phase was re-extracted with phenol chloroform. Nucleic acids were precipitated by addition of 1/8 volume of 4.4 M sodium acetate and 1 volume of isopropanol followed by centrifugation. Nucleic acid were dried and resuspended in 500 microL TE (10 mM Tris, 1 mM EDTA). A small aliquot (1 microL) of the nucleic acid solution was separated on 0.4% agarose gels next to molecular weight marker to confirm that molecular weight was $\geqq 50$ kb.

A 26S ribosomal gene fragment was generated by PCR as follows. The PCR reaction contained 50 mM KCl, 10 mM Tris-HCl (pH 9), 0.1% Triton X-100, 2.5 mM $MgCl_2$, 0.2 mM each dNTP, 5 units of Taq polymerase (MBI Fermentas, USA), 100 ng of genomic DNA of the magenta-glucuro.CHA-negative yeast strain and PCR primers MWG619 (SEQ ID NO:104) and MWG620 (SEQ ID NO:105) at a final concentration of 1 µM. Amplification was carried out for 35 cycles, each comprising 45 sec at 94° C., 45 sec at 55° C., and 1 min at 72° C. A PCR product of approximately 600 bp was excised from agarose gels and sequenced directly using the primers MWG619 (SEQ ID NO:104) and MWG620 (SEQ ID NO:105). A BLASTN search against NT (Public DNA from NCBI) was conducted using the resulting DNA sequence. As shown in Table the sequence was found to be 99% identical to various entries of 26s ribosomal sequences derived from *Pichia anomala*. The 26s ribosomal DNA fragment of the *Pichia anomala* yeast strain isolated by applicants from a cured meat sample is set forth as SEQ ID NO:137.

TABLE 39

BLASTN results generated with the sequence of a magenta-glucuro.CHA-negative yeast strain derived from cured meat

| Ranking | Sequence info | Sequence info |
|---|---|---|
| 1 | >gi\|171194254\|gb\|EU560879.1\|*Pichia anomala* strain 8 26S ribosomal RNA gene, partial sequence Length = 604 | Score = 1031 bits (520), Expect = 0.0<br>Identities = 527/528 (99%), Gaps = 1/528 (0%)<br>Strand = Plus/Minus |
| 2 | >gi\|165967963\|gb\|EU327111.1\|*Pichia anomala* strain TJY9d 26S ribosomal RNA gene, partial sequence Length = 614 | Score = 1031 bits (520), Expect = 0.0<br>Identities = 527/528 (99%), Gaps = 1/528 (0%)<br>Strand = Plus/Minus |

Generation of DGAT2 Specific Probe using PCR

A DGAT2 gene fragment was generated by PCR as follows. The PCR reaction contained 50 mM KCl, 10 mM Tris-HCl (pH 9), 0.1% Triton X-100, 2.5 mM MgCl$_2$, 0.2 mM each dNTP, 5 units of Taq polymerase (MBI Fermentas, USA), 100 ng of genomic DNA of *Pichia anomala* and PCR primers P7 (SEQ ID NO:107) and P8 (SEQ ID NO:108) at a final concentration of 1 μM. Amplification was carried out for 35 cycles, each comprising 45 sec at 94° C., 45 sec at 52° C., and 1 min at 72° C. A PCR product of approximately 270 bp was excised from agarose gels, cloned and sequenced using standard techniques. One plasmid clones were identified that contained a cloned PCR product of 263 bp. The nucleotide and deduced amino acid sequence of this PCR product are set forth as SEQ ID NO:138 and SEQ ID NO:139. A BLASTP search of the curated fungal protein database at NCBI was conducted. Based on a CLUSTALW alignment, the deduced amino acid sequence of the PCR product shares 66.7% sequence identity to an unnamed protein product from *Kluyveromyces lactis* with GENBANK accession number XP_455588 which represents the protein with the closest similarity in this database. The deduced amino acid sequence of this PCR product also shares 60.9% sequence identity to Dga1 of *Saccharomyces cerevisiae* with GENBANK accession number NP_014888.

Cosmid Library Construction, Screening and Sequencing of a DGAT2 Gene

Genomic DNA of *Pichia anomala* was partially digested with MboI. Briefly, approximately 10 μg of genomic DNA were digested with 0.5 units of MboI (NEB, USA) in a final volume of 100 μL in the presence of 0.1 mg mL$^{-1}$ BSA, and 0.1 mg mL$^{-1}$ DNAse-free RNAse (Quiagen, USA) 100 mM NaCl, 50 mM Tris-HCl, 10 mM MgCl$_2$, 1 mM DTT, pH 7.9. Aliquots of 25 μL were removed after 30, 60, 120 and 180 seconds respectively and combined in a tube that contained 5 μL of 500 mM EDTA. The partially digested DNA was purified and concentrated to a final volume of 10 μL using DNA Clean and Concentrator™ spin columns (Zymoresearch, USA) according to instructions of the manufacturer. The DNA was ligated to 2 μg of linearized pLAFR3DNA (B. Staskawicz et al., Journal of bacteriology (1987), 169(12), 5789-94) that had been completely digested with BamHI and dephosphorylated with Antarctic Phosphatase (NEB, USA). The ligation reaction was invitro-packaged and transfected into *E. coli* cells of strain NM554 (Stratagene, USA) using MAXPLAX packaging extracts (EPICENTRE Biotechnologies, USA) according to instructions of the manufacturer. Transfected cells were added to 15 mL of LB medium, incubated at 37° C. on Lab shaker set to 250 rpm. Glycerol was added to a final concentration of 15% (w/w) and the cell suspension was frozen using a dry ice methanol mixture. The titer of the cosmid library was determined by plating serial dilutions of the thawed cell suspension on solidified LB medium containing 10 mg L$^{-1}$ of tetracycline. Approximately 20,000 cosmid clones were plated on selective media, transferred to Biodyne B membranes (PALL Corporation, USA) and screened with a $^{32}$P labeled probe corresponding to the cloned PCR product derived from *Pichia anomala* set forth as SEQ ID NO;138 according to stardard protocols. Cesium chloride density gradient centrifugation was used as described in T. Maniatis et al. Molecular Cloning: A Laboratory Manual. (1982), 545 pp., was used to purify cosmid DNA from liquid cultures derived from colonies that hybridized to the probe under stringent conditions. Five hybridization-positive cosmid clones were sequenced using five primers with SEQ ID NOs 140 through 144 (Table 40). Sequences were assembled using the SEQMAN program of the LASER-GENE™ 7.1.1 software package (DNASTAR, INC., USA). DNA sequencing of five independently isolated cosmids with said primers produced DNA sequences that could be assembled into a single sequence of 2062 bp referred to as PA_DAGT2 gene set forth as SEQ ID NO:145. It contains and ORF of 1593 bp referred to as PA_DGAT2 (SEQ ID NO:146) and encodes a protein with a deduced sequence of 429 amino acids set forth as SEQ ID NO:147. A BLASTP search of the curated fungal protein database at NCBI was conducted. The PA_DGAT2 gene product shares 48.2% sequence identity in a CLUSTALW alignment to a gene product derived GENBANK accession number NP_983542 from *Ashbya gossypii* ATCC 10895. This product is annotated as having similarity to a protein family containing acyltransferases involved in phospholipid biosynthesis and other proteins of unknown function. The deduced amino acid sequences of PA_DGAT2 also shares 46.1% sequence identity to Dga1 of *Saccharomyces cerevisiae* with GENBANK accession number NP_014888.

TABLE 40

Primers used for sequencing of cosmid clones derived from *Pichia anomala*

| Name | Sequence | SEQ ID NO: |
|---|---|---|
| MWG 653 | CCTTGAGTGGATTTGGTGGTATTGGAACTGACG | 140 |
| MWG 654 | CGTCAGTTCCAATACCACCAAATCCACTCAAGG | 141 |
| MWG 655 | GCCCTCAAAATATTGAAGCAAGGATTCTCC | 142 |
| MWG 656 | GGAGAATCCTTGCTTCAATATTTTGAGGGC | 143 |
| MWG 660 | GGTGGTATTGGAACTGACGG | 144 |

Example 20

Cloning and Sequencing of DGAT2 from *Debarvomvces hansenii*

Isolation of *Debaryomyces hansenii* from a Cured Meat Sample

A Sopressata sausage was purchased from a local grocery store. A small portion of the sausage, approximately 10 grams, was homogenized in a sterile solution of 0.1% Triton-X 100 using a Waring blender. Glycerol was added to the sausage suspension to a final concentration of 15% (w/w). Serial dilutions of the sausage suspension were plated on solid media prepared using premade Yeast Morphology Agar medium (HiMedia Laboratories, India) containing 150 mg L$^{-1}$ of chloramphenicol. Plates were incubated at room temperature for one week. Individual colonies were re-streaked on media with identical composition with the exception that magenta-glucuro.CHA (Bromo-6-chloro-3-indolyl-β-D-glucuronide cyclohexylammonium salt (Sigma, USA)) was added to the medium at a concentration of 200 mg L$^{-1}$.

Several yeast isolates produced dark-violet colonies when streaked on media containing magenta-glucuro.CHA. According to M. Quiros et al (Journal of Food Protection (2005), 68(4), 808-814) this calorimetric reaction provides reliable means for identification of *Debaryomyces hansenii*.

Genomic DNA Isolation

A liquid culture (50 mL YPD medium) of a magenta-glucuro.CHA-positve yeast strain was grown at 28° C. for 72 h, at 250 rpm. Yeast cells were collected by centrifugation and washed in deionized water. Yeast cells were resuspended in 2 mL of STE buffer (0.1 M sorbitol, 10 mM Tris/HCl, pH 7.5, 1 mM EDTA) containing 10 mg mL$^{-1}$ of Zymolase (Zymo Research Corporation, California, USA) and incubated for 2 hours at 37° C. Total genomic DNA was isolated from Yeast spheroplasts as follows. The yeast suspension was lysed in 4 mL of Urea Extraction buffer (0.3125 M NaCl, 50 mM Tris HCl, pH 8.0, 20 mM EDTA, 1% sarkosine) and equal volume of phenol /chloroform was added followed by thorough mixing. After centrifugation the aqueous phase was re-extracted with phenol chloroform. Nucleic acids were precipitated by addition of 1/8 volume of 4.4 M sodium acetate and 1 volume of isopropanol followed by centrifugation. Nucleic acid were dried and resuspended in 500 microL TE (10 mM Tris, 1 mM EDTA). A small aliquot (1 microL) of the nucleic acid solution was separated on 0.4% agarose gels next to molecular weight marker to confirm that molecular weight was ≧50 kb.

A DGAT2 gene fragment was generated by PCR as follows. The PCR reaction contained 50 mM KCl, 10 mM Tris-HCl (pH 9), 0.1% Triton X-100, 2.5 mM MgCl$_2$, 0.2 mM each dNTP, 5 units of Taq polymerase (MBI Fermentas, USA), 100 ng of genomic DNA of the magenta-glucuro.CHA-positve yeast strain and PCR primers P7 (SEQ ID NO:107) and P8 (SEQ ID NO:108) at a final concentration of 0.2 µM. Amplification was carried out for 35 cycles, each comprising 45 sec at 94° C., 45 sec at 52° C., and 1 min at 72° C. A PCR product of approximately 350 bp was excised from agarose gels, cloned and sequenced using standard techniques. Several plasmid clones were identified that contained a cloned PCR product of 328 bp. The nucleotide and deduced amino acid sequence of this PCR product are set forth as SEQ ID NO:148 and SEQ ID NO:149. Based on a CLUTALW alignment the deduced amino acid sequence of the PCR product shares 95.4% sequence identity to hypothetical protein DEHA0C13101g from *Debaryomyces hansenii*, CBS767. This gene which represents the best hit in public sequence databases has GENBANK number XP_458203 and is annotated as having similarity to acyltransferases involved in phospholipid biosynthesis and other proteins of unknown function.

Cosmid Library Construction, Screening and Sequencing of a DGAT2 Gene

Genomic DNA of the magenta-glucuro.CHA-positve yeast strain was partially digested with MboI. Briefly, approximately 10 µg of genomic DNA were digested with 0.5 units of MboI (NEB, USA) in a final volume of 100 µL in the presence of 0.1 mg mL$^{-1}$ BSA, and 0.1 mg mL$^{-1}$ DNAse-free RNAse (Quiagen, USA) 100 mM NaCl, 50 mM Tris-HCl, 10 mM MgCl$_2$, 1 mM DTT, pH 7.9. Aliquots of 25 µL were removed after 30, 60, 120 and 180 seconds respectively and combined in a tube that contained 5 µL of 500 mM EDTA. The partially digested DNA was purified and concentrated to a final volume of 10 µL using DNA Clean and Concentrator™ spin columns (Zymoresearch, USA) according to instructions of the manufacturer. The DNA was ligated to 2 µg of linearized pLAFR3DNA (B. Staskawicz et al., Journal of bacteriology (1987), 169(12), 5789-94) that had been completely digested with BamHI and dephosphorylated with Antarctic Phosphatase (NEB, USA). The ligation reaction was invitro-packaged and transfected into *E. coli* cells of strain NM554 (Stratagene, USA) using MAXPLAX packaging extracts (EPICENTRE Biotechnologies, USA) according to instructions of the manufacturer. Transfected cells were added to 15 mL of LB medium, incubated at 37° C. on Lab shaker set to 250 rpm. Glycerol was added to a final concentration of 15% (w/w) and the cell suspension was frozen using a dry ice methanol mixture. The titer of the cosmid library was determined by plating serial dilutions of the thawed cell suspension on solidified LB medium containing 10 mg L$^{-1}$ of tetracycline. Approximately 20,000 cosmid clones were plated on selective media, transferred to Biodyne B membranes (PALL Corporation, USA) and screened with a $^{32}$P labeled probe corresponding to the cloned PCR product derived from the magenta-glucuro.CHA-positve yeast strain according to standard protocols. Cesium chloride density gradient centrifugation was used as described in T. Maniatis et al. Molecular Cloning: A Laboratory Manual. (1982), 545 pp., was used to purify cosmid DNA from liquid cultures derived from colonies that hybridized to the probe under stringent conditions. Cosmid clones were sequenced using ten primers with SEQ ID NOs 150 through 159 (Table 41). Sequences were assembled using the SEQMAN program of the LASERGENE™ 7.1.1 software package (DNASTAR, INC., USA). DNA sequencing of three independently isolated cosmids with said primers produced DNA sequences that could be assembled into a single sequence. The consensus sequence of 2800 nucleotides derived from this effort is set for as SEQ ID NO:160. It contains an ORF of 2028 bp (SEQ ID NO:161) that can be translated into a protein of 675 amino acids (SEQ ID NO:162). This protein shares 91.3% sequence identity in a ClustalW alignment to hypothetical protein DEHA0C13101g from Debaryomyces hansenii, CBS767. This gene has GENBANK number XP_458203. It represents the gene with the closest similarity to the gene of SEQ ID NO:161 and is annotated as having similarity to acyltransferases involved in phospholipid biosynthesis and other proteins of unknown function.

TABLE 41

Primers used for sequencing of cosmid clones derived from *Debaryomyces hansenii*

| | Sequence | SEQ ID NO: |
|---|---|---|
| MWG 621 | CGGAATGAACCATATCAGCCTCC | 150 |
| MWG 622 | GGAGGCTGATATGGTTCATTCCG | 151 |
| MWG 623 | GAGCTTGGGATTGACAAGTGCATCTTAC | 152 |
| MWG 624 | GTAAGATGCACTTGTCAATCCCAAGCTC | 153 |
| MWG 631 | GGCTGGATCATCTGGATATTTGTGATCC | 154 |
| MWG 632 | GGATCACAAATATCCAGATGATCCAGCC | 155 |
| MWG 633 | GCCAGGATGATGACTCCTCAAGTCCAAG | 156 |
| MWG 634 | CTTGGACTTGAGGAGTCATCATCCTGGC | 157 |
| MWG 635 | GCTAACCCAAAACCGGGATCTCTTGG | 158 |
| MWG 636 | CAGTGCCATTTTTCAGTGCCAGAGGTG | 159 |

Example 21

Cloning and Sequencing of DGAT2 from *Candida zeylanoides*

Isolation of *Candida zeylanoides* from a Cured Meat Sample

A sample of Parma Ham imported from Parma, Italy was purchased from a local Italian deli store. A small portion of the ham, approximately 10 grams, was homogenized in a sterile solution of 0.1% Triton-X 100 using a Waring blender. Glycerol was added to the sausage suspension to a final concentration of 15% (w/w). Serial dilutions of the sausage suspension were plated on solid media prepared using premade Yeast Morphology Agar medium (HiMedia Laboratories, India) containing 150 mg L$^{-1}$ of chloramphenicol. Plates were incubated at room temperature for one week. Individual colonies were re-streaked on media with identical composition and used for strain identification by 26S ribosomal DNA sequencing. Briefly, a small protein of yeast cells were added to 100 µL of STE buffer containing 10 mg mL$^{-1}$ zymolase. Cells were resuspended and incubated for 30 min at 37° C. The cell suspension was heated to 95° C. for 10 min and cooled to room temperature. 5 µL of cell lysine were used in a PCR reaction for amplification of a 26S ribosomal DNA fragment. The PCR reaction contained 50 mM KCl, 10 mM Tris-HCl (pH 9), 0.1% Triton X-100, 2.5 mM MgCl$_2$, 0.2 mM each dNTP, 5 units of Taq polymerase (MBI Fermentas, USA), 5 uL of yeast cell lysate and PCR primers MWG619 (SEQ ID NO:104) and MWG620 (SEQ ID NO:105) at a final concentration of 1 µM. Amplification was carried out for 35 cycles, each comprising 45 sec at 94° C., 45 sec at 55° C., and 1 min at 72° C. PCR products of approximately 600 bp were excised from agarose gels and sequenced directly using the primers MWG619 (SEQ ID NO:104) and MWG620 (SEQ ID NO:105). A BLASTN search against NT (Public DNA from NCBI) was conducted using the resulting DNA sequence. The vast majority of yeast colonies derived from the Parma Ham samples produced PCR products that when subjected to DNA sequencing showed >99% identity to 26S ribosomal DNA sequences of Debaryomyces hansenii. However, one yeast colony with morphological features different from those of the majority of yeast colonies derived from the Parma Ham sample could be identified that produced a 26S ribosomal genomic DNA sequence (SEQ ID NO:163) that showed high similarity (99% identity) to a sequence from *Candida zeylanoides* (Table)

tion of 1/8 volume of 4.4 M sodium acetate and 1 volume of isopropanol followed by centrifugation. Nucleic acid were dried and resuspended in 500 microL TE (10 mM Tris, 1 mM EDTA). A small aliquot (1 microL) of the nucleic acid solution was separated on 0.4% agarose gels next to molecular weight marker to confirm that molecular weight was ≧50 kb.

Generation of DGAT2 Specific Probe Using PCR

A DGAT2 gene fragment was generated by PCR as follows. The PCR reaction contained 50 mM KCl, 10 mM Tris-HCl (pH 9), 0.1% Triton X-100, 2.5 mM MgCl$_2$, 0.2 mM each dNTP, 5 units of Taq polymerase (MBI Fermentas, USA), 100 ng of genomic DNA of *Candida zeylanoides* and PCR primers P7 (SEQ ID NO:107) and P8 (SEQ ID NO:108) at a final concentration of 1 µM. Amplification was carried out for 35 cycles, each comprising 45 sec at 94° C., 45 sec at 52° C., and 1 min at 72° C. A PCR product of approximately 330 bp was excised from agarose gels, cloned and sequenced using standard techniques. One plasmid clones were identified that contained a cloned PCR product of 325 bp. The nucleotide and deduced amino acid sequence of this PCR product are set forth as SEQ ID NO:164 and SEQ ID NO:165. A BLASTP search of the curated fungal protein database at NCBI was conducted. Based on a CLUSTALW alignment, the deduced amino acid sequence of the PCR product shares 79.6% sequence identity to a protein product from *Pichia stipidis* with GENBANK accession number XP_001382973. This protein product is annotated as hypothetical protein with similarity to diacylglycerol acyltransferases. It represents the protein with the closest similarity in this database.

Cosmid Library Construction, Screening and Sequencing of a DGAT2 Gene

Genomic DNA of *Candida zeylanoides* was partially digested with MboI. Briefly, approximately 10 µg of genomic DNA were digested with 0.5 units of MboI (NEB, USA) in a final volume of 100 µL in the presence of 0.1 mg mL$^{-1}$ BSA,

TABLE 42

BLASTN results generated with 26s ribosomal sequence from a yeast strain derived from Parma Ham

| Ranking | Sequence info | Blast score |
|---|---|---|
| 1 | >gi\|165967959\|gb\|EU327107.1\|*Candida zeylanoides* strain TJY7b 26S ribosomal RNA gene, partial sequence Length = 615 | Score = 1068 bits (539), Expect = 0.0<br>Identities = 549/551 (99%), Gaps = 1/551 (0%)<br>Strand = Plus/Plus |
| 2 | >gi\|165967958\|gb\|EU327106.1\|*Candida zeylanoides* strain TJY18b 26S ribosomal RNA gene, partial sequence Length = 605 | Score = 1068 bits (539), Expect = 0.0<br>Identities = 549/551 (99%), Gaps = 1/551 (0%)<br>Strand = Plus/Plus |

Based on this result the strain was identified as *Candida zeylanoides*.

Genomic DNA Isolation

A liquid culture (50 mL, YPD medium) of the *Candida zeylanoides* strain was grown at 28° C. for 72 h, at 250 rpm. Yeast cells were collected by centrifugation and washed in deionized water. Yeast cells were resuspended in 2 mL of STE buffer (0.1 M sorbitol, 10 mM Tris/HCl, pH 7.5, 1 mM EDTA) containing 10 mg mL$^{-1}$ of Zymolase (Zymo Research Corporation, California, USA) and incubated for 2 hours at 37° C. Total genomic DNA was isolated from Yeast spheroplasts as follows. The yeast suspension was lysed in 4 mL of Urea Extraction buffer (0.3125 M NaCl, 50 mM Tris HCl, pH 8.0, 20 mM EDTA, 1% sarkosine) and equal volume of phenol /chloroform was added followed by thorough mixing. After centrifugation the aqueous phase was re-extracted with phenol chloroform. Nucleic acids were precipitated by addiand 0.1 mg mL$^{-1}$ DNAse-free RNAse (Quiagen, USA) 100 mM NaCl, 50 mM Tris-HCl, 10 mM MgCl$_2$, 1 mM DTT, pH 7.9. Aliquots of 25 µL were removed after 30, 60, 120 and 180 seconds respectively and combined in a tube that contained 5 µL of 500 mM EDTA. The partially digested DNA was purified and concentrated to a final volume of 10 µL using DNA Clean and Concentrator™ spin columns (Zymoresearch, USA) according to instructions of the manufacturer. The DNA was ligated to 2 µg of linearized pLAFR3DNA (B. Staskawicz et al., Journal of bacteriology (1987), 169(12), 5789-94) that had been completely digested with BamHI and dephosphorylated with Antarctic Phosphatase (NEB, USA). The ligation reaction was invitro-packaged and transfected into *E. coli* cells of strain NM554 (Stratagene, USA) using MAXPLAX packaging extracts (EPICENTRE Biotechnologies, USA) according to instructions of the manufacturer. Transfected cells were added to 15 mL of LB medium, incubated at 37° C. on Lab shaker set to 250 rpm. Glycerol was added to a final concentration of 15% (w/w) and the cell suspension was frozen using a dry ice methanol mixture. The titer of the cosmid library was determined by plating serial dilutions of the thawed cell suspension on solidified LB medium containing 10 mg $L^{-1}$ of tetracycline. Approximately 20,000 cosmid clones were plated on selective media, transferred to Biodyne B membranes (PALL Corporation, USA) and screened with a $^{32}$P labeled probe corresponding to the cloned PCR product derived from *Pichia anomala* according to standard protocols. Cesium chloride density gradient centrifugation was used as described in T. Maniatis et al. Molecular Cloning: A Laboratory Manual. (1982), 545 pp., was used to purify cosmid DNA from liquid cultures derived from colonies that hybridized to the probe under stringent conditions. Four cosmid clones were sequenced using eight primers with SEQ ID NOs 166 through 173 (Table ). Sequences were assembled using the SEQMAN program of the LASERGENE™ 7.1.1 software package (DNASTAR, INC., USA ). DNA sequencing of four independently isolated cosmids with said primers produced DNA sequences that could be assembled into a single sequence of 3021 bp referred to as CZ_DAGT2 gene set forth as SEQ ID NO:174. It contains and ORF of 1695 bp referred to as CZ_DGAT2 (SEQ ID NO:175) and encodes a protein with a deduced sequence of 564 amino acids set forth as SEQ ID NO:176. A BLASTP search of the curated fungal protein database at NCBI was conducted. Based on a CLUSTALW alignment, the CZ_DGAT2 gene product shares 57.6% sequence identity in a CLUSTALW alignment to a gene product derived GENBANK accession number XP_001527478 from *Lodderomyces elongisporus*, NRRL YB-4239. This product is annotated as hypothetical protein with similarity to diacylglycerol acyltransferases. It represents the protein with the closest similarity in this database.

TABLE 43

Primers used for sequencing of cosmid clones derived from *Candida zeylanoides*

| Name | Sequence | SEQ ID NO: |
|---|---|---|
| MWG722 | GTCATTTCGATGGGGGTGATGGGCAC | 166 |
| MWG723 | GTGCCCATCACCCCCATCGAAATGAC | 167 |
| MWG724 | GCGCCGCGGCAAAGAACATCAAGAGC | 168 |
| MWG725 | GCTCTTGATGTTCTTTGCCGCGGCGC | 169 |
| MWG726 | CCCACTGGCGGGCGCCGACAGCACGC | 170 |
| MWG727 | GCGTGCTGTCGGCGCCCGCCAGTGGG | 171 |
| MWG728 | GCGCGTCTACGAGGATAACAAGGACAAG | 172 |
| MWG729 | CTTGTCCTTGTTATCCTCGTAGACGCGC | 173 |

Example 22

Cloning and Sequencing of DGAT1 and DGAT2 from *Lilomyces starkyi*

RNA Isolation and cDNA Synthesis

*Lipomyces starkeyi* (Catalog number 78-23T) was purchased from the PHAFF collection (UC Davis, California, USA). A liquid culture (50 mL, YPD medium) of *Lipomyces starkeyi* was grown at 28° C. Cells were harvested by centrifugation washed with deonized water and collected again by centrifugation. Total RNA was isolated from the resulting cell culture pellet using the hot phenol method exactly as described in Current Protocols in Molecular Biology (John Wiley & Sons, Somerset, N.J.) but where all reagent volumes were increased by 10-fold (e.g. cell pellet was re-suspended in 4 mL of TES solution instead of 400 µL). The final RNA pellet was dissolved in 1 mL of water and the concentration was determined to be 500 ng/uL.

cDNA was synthesized from 1 µg of total RNA (2 µL) using the SuperScript™ First-Strand Synthesis System for RT-PCR Kit (Invitrogen™ Life Technologies, Carlsbad, Calif.) with the provided oligo(dT) primer according to the manufacturer's protocol. After RNase H treatment the cDNA was used as PCR template for generation of DGAT1 And DGAT2-specific gene fragments as follows.

Generation of a DGAT1 Specific Probe using PCR

A DGAT1 gene fragment was generated by PCR as follows. The PCR reaction contained 50 mM KCl, 10 mM Tris-HCl (pH 9), 0.1% Triton X-100, 2.5 mM $MgCl_2$, 0.2 mM each dNTP, 5 units of Taq polymerase (MBI Fermentas, USA), 2 µL of *Lipomyces starkeyi* cDNA and PCR primers DGAT1 FWD (SEQ ID NO:113) and DGAT1 REV (SEQ ID NO:114) at a final concentration of 1 µM. Amplification was carried out for 35 cycles, each comprising 45 sec at 94° C., 45 sec at 52° C., and 1 min at 72° C. A PCR product of approximately 500 bp was excised from agarose gels, cloned and sequenced using standard techniques. One plasmid clones were identified that contained a cloned PCR product of 517 bp. The nucleotide and deduced amino acid sequence of this PCR product are set forth as SEQ ID NO:177 and SEQ ID NO:178. A BLASTP search of the annotated fungal protein database at NCBI was conducted. Based on a CLUSTALW alignment, the deduced amino acid sequence of the PCR product shares 66.1% sequence identity to a hypothetical protein product from *Gibberella zeae* PH-1 with GENBANK accession number XP_386864 which represents the protein with the closest similarity in this database. The protein has been annotated as member of the MBOAT (membrane bound O-acyl transferase) family of membrane proteins that contains a variety of acyltransferase enzymes.

Generation of a DGAT2 Specific Probe Using PCR

A DGAT2 gene fragment was generated by PCR as follows. The PCR reaction contained 50 mM KCl, 10 mM Tris-HCl (pH 9), 0.1% Triton X-100, 2.5 mM $MgCl_2$, 0.2 mM each dNTP, 5 units of Taq polymerase (MBI Fermentas, USA), 2 µL of *Lipomyces starkeyi* cDNA and PCR primers P7 (SEQ ID NO:) and P8 (SEQ ID NO:) at a final concentration of 1 µM. Amplification was carried out for 35 cycles, each comprising 45 sec at 94° C., 45 sec at 52° C., and 1 min at 72° C. A PCR product of approximately 270 bp was excised from agarose gels, cloned and sequenced using standard techniques. One plasmid clones were identified that contained a cloned PCR product of 263 bp. The nucleotide and deduced amino acid sequence of this PCR product are set forth as SEQ ID NO:179 and SEQ ID NO:180. A BLASTP search of the annotated fungal protein database at NCBI was conducted. Based on a CLUSTALW alignment, the deduced amino acid sequence of the PCR product shares 66.1% sequence identity to a hypothetical protein product from *Yarrowia lipolytica* CLIB122 with GENBANK accession number XP_504700 which represents the protein with the closest similarity in this database. The amino acid sequence of this protein identical to that of YL_DGAT 2 described in PCT Publication No. WO 2005/003322 and differs in one amino acid residue from that of YL-DGAT2 set forth as SEQ ID NO:10 for reasons that are outlined in Example 1.

Genomic DNA Isolation

A liquid culture (50 mL, YPD medium) of *Lipomyces starkeyi* was grown at 28° C. for 72 h, at 250 rpm. Yeast cells were collected by centrifugation and washed in deionized water. Yeast cells were resuspended in 2 mL of STE buffer (0.1 M sorbitol, 10 mM Tris/HCl, pH 7.5, 1 mM EDTA) containing 10 mg mL$^{-1}$ of Zymolase (Zymo Research Corporation, California, USA) and incubated for 2 hours at 37° C. Total genomic DNA was isolated from Lipomyces spheroplasts as follows. The yeast suspension was lysed in 4 mL of Urea Extraction buffer (0.3125 M NaCl, 50 mM Tris HCl, pH 8.0, 20 mM EDTA, 1% sarkosine) and equal volume of phenol/chloroform was added followed by thorough mixing. After centrifugation the aqueous phase was re-extracted with phenol chloroform. Nucleic acids were precipitated by addition of 1/8 volume of 4.4 M sodium acetate and 1 volume of isopropanol followed by centrifugation. Nucleic acid were dried and resuspended in 500 microL TE (10 mM Tris, 1 mM EDTA). A small aliquot (1 microL) of the nucleic acid solution was separated on 0.4% agarose gels next to molecular weight marker to confirm that molecular weight was ≧50 kb.

Cosmid Library Construction

Genomic DNA of *Lipomyces starkeyi* was partially digested with MboI. Briefly, approximately 10 μg of genomic DNA were digested with 0.5 units of MboI (NEB, USA) in a final volume of 100 μL in the presence of 0.1 mg mL$^{-1}$ BSA, and 0.1 mg mL$^{-1}$ DNAse-free RNAse (Quiagen, USA) 100 mM NaCl, 50 mM Tris-HCl, 10 mM MgCl$_2$, 1 mM DTT, pH 7.9. Aliquots of 25 μL were removed after 30, 60, 120 and 180 seconds respectively and combined in a tube that contained 5 μL of 500 mM EDTA. The partially digested DNA was purified and concentrated to a final volume of 10 μL using DNA Clean and Concentrator™ spin columns (Zymoresearch, USA) according to instructions of the manufacturer. The DNA was ligated to 2 μg of linearized pLAFR3DNA (B. Staskawicz et al., Journal of bacteriology (1987), 169(12), 5789-94) that had been completely digested with BamHI and dephosphorylated with Antarctic Phosphatase (NEB, USA). The ligation reaction was invitro-packaged and transfected into *E. coli* cells of strain NM554 (Stratagene, USA) using MAXPLAX packaging extracts (EPICENTRE Biotechnologies, USA) according to instructions of the manufacturer. Transfected cells were added to 15 mL of LB medium, incubated at 37° C. on Lab shaker set to 250 rpm. Glycerol was added to a final concentration of 15% (w/w) and the cell suspension was frozen using a dry ice methanol mixture. The titer of the cosmid library was determined by plating serial dilutions of the thawed cell suspension on solidified LB medium containing 10 mg L-1 of tetracycline.

Screening and Sequencing of Cosmids Comprising *Lipomyces starkeyi* DGAT1

Approximately 20,000 cosmid clones were plated on selective media, transferred to Biodyne B membranes (PALL Corporation, USA) and screened with a $^{32}$P labeled probe corresponding to the cloned DGAT1-related PCR product of SEQ ID NO: derived from *Lipomyces starkeyi* according to standard protocols. Cesium chloride density gradient centrifugation was used as described in T. Maniatis et al. Molecular Cloning: A Laboratory Manual. (1982), 545 pp., was used to purify cosmid DNA from liquid cultures derived from colonies that hybridized to the probe under stringent conditions. Two cosmid clones were sequenced using six primers with SEQ ID NOs 181 through 188 (Table 44). Sequences were assembled using the SEQMAN program of the LASER-GENE™ 7.1.1 software package (DNASTAR, INC., USA). DNA sequencing of two independently isolated cosmids with said primers produced DNA sequences that could be assembled into a single sequence of 3343 bp referred to as LS_DGAT1 gene set forth as SEQ ID NO:189. A TBLASTX search of the annotated fungal protein database at NCBI was conducted with the LS_DGAT1 gene (SEQ ID NO:189) which showed similarities to hypothetical fungal proteins with similarities to acyltransferases. At also revealed that the LS_DGAT1 gene is interrupted by introns. Therefore the PCR amplification and cloning of the LS DGAT1 cDNA was necessary. It is described in Example 32.

TABLE 44

Primers used for sequencing of DGAT1 cosmid clones derived from *Lipomyces starkeyi*

| Name | Sequence | SEQ ID NO: |
|---|---|---|
| MWG713 | GTCAAGCGGATTCTGGAGATGGTGGGCC | 181 |
| MWG714 | GGCCCACCATCTCCAGAATCCGCTTGAC | 182 |
| MWG715 | CCGCTTGTGCGCCGCGGGTGGAATTCTGCG | 183 |
| MWG716 | CGCAGAATTCCACCCGCGGCGCACAAGCGG | 184 |
| MWG717 | CGCTGAGCGAAGCGACGTAG | 185 |
| MWG718 | CCCATTTTGGGGTTGGAGCG | 186 |
| MWG719 | TTGATTTGCTTCTGGTCCCG | 187 |
| MWG720 | CGTGCCCATTGCATGGATTC | 188 |

Screening and Sequencing of Cosmids Comprising *Lipomyces starkeyi* DGAT2

Approximately 20,000 cosmid clones were plated on selective media, transferred to Biodyne B membranes (PALL Corporation, USA) and screened with a $^{32}$P labeled probe corresponding to the cloned DGAT2-related PCR product of SEQ ID NO: derived from *Lipomyces starkeyi* according to stardard protocols. Cesium chloride density gradient centrifugation was used as described in T. Maniatis et al. Molecular Cloning: A Laboratory Manual. (1982), 545 pp., was used to purify cosmid DNA from liquid cultures derived from colonies that hybridized to the probe under stringent conditions. Four cosmid clones were sequenced using four primers with SEQ ID NOs 190 through 193 (Table 45). Sequences were assembled using the SEQMAN program of the LASER-GENE™ 7.1.1 software package (DNASTAR, INC., USA). DNA sequencing of four independently isolated cosmids with said primers produced DNA sequences that could be assembled into a single sequence of 2090 bp referred to as LS_DAGT2 gene set forth as SEQ ID NO:194. A TBLASTX search of the annotated fungal protein database at NCBI was conducted with the LS_DGAT2 gene (SEQ ID NO:194) which showed similarities to hypothetical fungal proteins with similarities to acyltransferases. At also revealed that the LS_DGAT2 gene is interrupted by introns. Therefore the PCR amplification and cloning of the LS DGAT2 cDNA was necessary. It is described in Example 29.

TABLE 45

Primers used for sequencing of DGAT2 cosmid clones derived from *Lipomyces starkeyi*

| Name | Sequence | SEQ ID NO: |
|---|---|---|
| MWG667 | GGGTGCGTTTGGTGCTATTGGTACGGAAGG | 190 |
| MWG668 | CCTTCCGTACCAATAGCACCAAACGCACCC | 191 |

TABLE 45-continued

Primers used for sequencing of DGAT2 cosmid
clones derived from *Lipomyces starkeyi*

| Name | Sequence | SEQ ID NO: |
|---|---|---|
| MWG669 | GGGATTGCTTCAGTATCTCGACGGTCTTG | 192 |
| MWG670 | CAAGACCGTCGAGATACTGAAGCAATCCC | 193 |

Example 23

Cloning and Sequencing of DGAT2 from *Rhodotorula glutinis*

RNA Isolation and cDNA Synthesis

*Rhodotorula glutinis* (Catalog number 68-255T) was purchased from the PHAFF collection (UC Davis, California). A liquid culture (50 mL, YPD medium) of *Rhodotorula glutinis* was grown at 28° C. Cells were harvested by centrifugation washed with deonized water and collected again by centrifugation. Total RNA was isolated from the resulting cell culture pellet using the hot phenol method exactly as described in Current Protocols in Molecular Biology (John Wiley & Sons, Somerset, N.J.) but where all reagent volumes were increased by 10-fold (e.g. cell pellet was re-suspended in 4 mL of TES solution instead of 400 µL). The final RNA pellet was dissolved in 1 mL of water and the concentration was determined to be 500 ng/uL. cDNA was synthesized from 1 µg of total RNA (2 µL) using the SuperScript™ First-Strand Synthesis System for RT-PCR Kit (Invitrogen™ Life Technologies, Carlsbad, Calif.) with the provided oligo(dT) primer according to the manufacturer's protocol. After RNase H treatment the cDNA was used as PCR template for generation of a DGAT2-specific gene fragments as follows.

Generation of a DGAT2 Specific Probe Using PCR

A DGAT2 gene fragment was generated by PCR as follows. The PCR reaction contained 50 mM KCl, 10 mM Tris-HCl (pH 9), 0.1% Triton X-100, 2.5 mM $MgCl_2$, 0.2 mM each dNTP, 5 units of Taq polymerase (MBI Fermentas, USA), 2 µL of *Rhodotorula glutinis* cDNA and PCR primers BM DGAT2 FWD (SEQ ID NO:111) and BM DGAT2 REV (SEQ ID NO:112) at a final concentration of 1 µM. Amplification was carried out for 35 cycles, each comprising 45 sec at 94° C., 45 sec at 52° C., and 1 min at 72° C. A PCR product of approximately 480 bp was excised from agarose gels, cloned and sequenced using standard techniques. Several plasmid clones were identified that contained a cloned PCR product of 474 bp. The nucleotide and deduced amino acid sequence of this PCR product are set forth as SEQ ID NO:195 and SEQ ID NO:196. A BLASTP search of the annotated fungal protein database at NCBI was conducted. Based on a CLUSTALW alignment, the deduced amino acid sequence of the PCR product shares 70.8% sequence identity to a hypothetical protein product from *Ustilago* maydis 521 with GENBANK accession number XP_760084 which represents the protein with the closest similarity in this database. This protein has been annotated as having similarity to acyltransferases involved in phospholipid biosynthesis and other proteins of unknown function.

Genomic DNA Isolation

A liquid culture (50 mL, YPD medium) of *Rhodotorula glutinis* was grown at 28° C. for 72 h, at 250 rpm. Yeast cells were collected by centrifugation and washed in deionized water. Yeast cells were resuspended in 2 mL of STE buffer (0.1 M sorbitol, 10 mM Tris/HCl, pH 7.5, 1 mM EDTA) containing 10 mg $mL^{-1}$ of Zymolase (Zymo Research Corporation, California, USA) and incubated for 2 hours at 37° C. Total genomic DNA was isolated from *Rhodotorula glutinis* spheroplasts as follows. The yeast suspension was lysed in 4 mL of Urea Extraction buffer (0.3125 M NaCl, 50 mM Tris HCl, pH 8.0, 20 mM EDTA, 1% sarkosine) and equal volume of phenol/chloroform was added followed by thorough mixing. After centrifugation the aqueous phase was re-extracted with phenol chloroform. Nucleic acids were precipitated by addition of 1/8 volume of 4.4 M sodium acetate and 1 volume of isopropanol followed by centrifugation. Nucleic acid were dried and resuspended in 500 microL TE (10 mM Tris, 1 mM EDTA). A small aliquot (1 microL) of the nucleic acid solution was separated on 0.4% agarose gels next to molecular weight marker to confirm that molecular weight was $\geq 50$ kb.

Cosmid Library Construction

Genomic DNA of *Rhodotorula glutinis* was partially digested with MboI. Briefly, approximately 10 µg of genomic DNA were digested with 0.5 units of MboI (NEB, USA) in a final volume of 100 µL in the presence of 0.1 mg $mL^{-1}$ BSA, and 0.1 mg $mL^{-1}$ DNAse-free RNAse (Quiagen, USA) 100 mM NaCl, 50 mM Tris-HCl, 10 mM $MgCl_2$, 1 mM DTT, pH 7.9. Aliquots of 25 µL were removed after 30, 60, 120 and 180 seconds respectively and combined in a tube that contained 5 µL of 500 mM EDTA. The partially digested DNA was purified and concentrated to a final volume of 10 µL using DNA Clean and Concentrator™ spin columns (Zymoresearch, USA) according to instructions of the manufacturer. The DNA was ligated to 2 µg of linearized pLAFR3DNA (B. Staskawicz et al., Journal of bacteriology (1987), 169(12), 5789-94) that had been completely digested with BamHI and dephosphorylated with Antarctic Phosphatase (NEB, USA). The ligation reaction was invitro-packaged and transfected into *E. coli* cells of strain NM554 (Stratagene, USA) using MAXPLAX packaging extracts (EPICENTRE Biotechnologies, USA) according to instructions of the manufacturer. Transfected cells were added to 15 mL of LB medium, incubated at 37° C. on Lab shaker set to 250 rpm. Glycerol was added to a final concentration of 15% (w/w) and the cell suspension was frozen using a dry ice methanol mixture. The titer of the cosmid library was determined by plating serial dilutions of the thawed cell suspension on solidified LB medium containing 10 mg $L^{-1}$ of tetracycline.

Screening and Sequencing of Cosmids Comprising *Rhodotorula glutinis* DGAT 2

Approximately 20,000 cosmid clones were plated on selective media, transferred to Biodyne B membranes (PALL Corporation, USA) and screened with a $^{32}P$ labeled probe corresponding to the cloned DGAT1-related PCR product of SEQ ID NO: derived from *Rhodotorula glutinis* according to stardard protocols. Cesium chloride density gradient centrifugation was used as described in T. Maniatis et al. Molecular Cloning: A Laboratory Manual. (1982), 545 pp., was used to purify cosmid DNA from liquid cultures derived from colonies that hybridized to the probe under stringent conditions. Seven cosmid clones were sequenced using seven primers with SEQ ID NOs 197 through 203 (Table 46). Sequences were assembled using the SEQMAN program of the LASERGENE™ 7.1.1 software package (DNASTAR, INC., USA). DNA sequencing of seven independently isolated cosmids with said primers produced DNA sequences that could be assembled into a single sequence of 2944 bp referred to as RG_DGAT2 gene set forth as SEQ ID NO:204. A TBLASTX search of the annotated fungal protein database at NCBI was conducted with the RG_DGAT2 gene (SEQ ID NO:204) which showed similarities to hypothetical fungal proteins with similarities to acyltransferases. At also revealed that the RG_DGAT2 gene is interrupted by introns. Therefore the PCR amplification and cloning of the RG_DGAT2 cDNA was necessary. It is described in Example 28.

TABLE 46

Primers used for sequencing of DGAT2 cosmid clones derived from Rhodotorula glutinis

| Name | Sequence | SEQ ID NO: |
|------|----------|------------|
| MWG649 | GCTTGATGAAGCCCTTGCGC | 197 |
| MWG650 | GCGCAAGGGCTTCATCAAGC | 198 |
| MWG651 | GCCAAAGTTGGCGATGGCGC | 199 |
| MWG652 | GCGCCATCGCCAACTTTGGC | 200 |
| MWG657 | GTGTGCGGCCTGAAACCGGG | 201 |
| MWG658 | GCAGTGGGTGCATGGGTCAG | 202 |
| MWG659 | GAAGGCGACGATGCCGTGGC | 203 |

Example 24

Cloning and Sequencing of DGAT2 from *Phaffia rhodozyma*

RNA Isolation and cDNA Synthesis

*Phaffia rhodozyma* (Catalog #67-210) was purchased from the PHAFF collection at UC Davis, CA, USA. A liquid culture (50 mL, YPD medium) of *Phaffia rhodozyma* was grown at 18° C. Cells were harvested by centrifugation washed with deionized water and collected again by centrifugation. Total RNA was isolated from the resulting cell culture pellet using the hot phenol method exactly as described in Current Protocols in Molecular Biology (John Wiley & Sons, Somerset, N.J.) but where all reagent volumes were increased by 10-fold (e.g. cell pellet was re-suspended in 4 mL of TES solution instead of 400 µL). The final RNA pellet was dissolved in 1 mL of water and the concentration was determined to be 500 ng/µL. cDNA was synthesized from 1 µg of total RNA (2 µL) using the SuperScript™ First-Strand Synthesis System for RT-PCR Kit (Invitrogen™ Life Technologies, Carlsbad, Calif.) with the provided oligo(dT) primer according to the manufacturer's protocol. After RNase H treatment the cDNA was used as PCR template for generation of a DGAT2-specific gene fragment as follows.

Generation of a DGAT2 Specific Probe Using PCR

A DGAT2 gene fragment was generated by PCR as follows. The PCR reaction contained 50 mM KCl, 10 mM Tris-HCl (pH 9), 0.1% Triton X-100, 2.5 mM $MgCl_2$, 0.2 mM each dNTP, 5 units of Taq polymerase (MBI Fermentas, USA), 2 µL of *Phaffia rhodozyma* cDNA and PCR primers BM DGAT2 FWD (SEQ ID NO:111) and BM DGAT2 REV (SEQ ID NO:112) at a final concentration of 1 µM. Amplification was carried out for 35 cycles, each comprising 45 sec at 94° C., 45 sec at 52° C., and 1 min at 72° C. A PCR product of approximately 400 bp was excised from agarose gels, cloned and sequenced using standard techniques. One plasmid clones were identified that contained a cloned PCR product of 397 bp. The nucleotide and deduced amino acid sequence of this PCR product are set forth as SEQ ID NO:205 and SEQ ID NO:206. A BLASTP search of the annotated fungal protein database at NCBI was conducted. A CLUSTALW alignment revealed that the deduced amino acid sequence of the PCR product shares 77.1% sequence identity to a hypothetical protein product from *Cryptococcus neoformans* var. *neoformans* B-3501A with GENBANK accession number XP_774736 which represents the protein with the closest similarity in this database. This protein has been annotated as having similarity to acyltransferases involved in phospholipid biosynthesis and other proteins of unknown function.

TABLE 47

Primers used for 3' and 5' RACE amplification of the DGAT2 transcript derived from *Phaffia rhodozyma*

| Name | Sequence | SEQ ID NO: |
|------|----------|------------|
| MWG709 | GTCATCGGGATGGGAGCTTTCGCCAACTTTGC | 207 |
| MWG710 | GCAAAGTTGGCGAAAGCTCCCATCCCGATGAC | 208 |
| MWG711 | CCCGGGAACAGCCGACTTGACACTCAAGAG | 209 |
| MWG712 | CTCTTGAGTGTCAAGTCGGCTGTTCCCGGG | 210 |
| 3' RACE | GGCCACGCGTCGACTAGTACTTTTTTTTTTTTT | 211 |
| 3' RACE ABR | GGCCACGCGTCGACTAGTAC | 212 |
| 5' RACE P | GGCCACGCGTCGACTAGTACGGGXXGGGXXGGGX XG | 213 |

Symbol (Meaning): R (G or A), Y (T or C), M (A or C), K (G or T), S (G or C), W (A or T), H (A or C or T), B (G or T or C), V (G or C or A), D (G or A or T), N (G or A or T or C), and X (Inosine)

3' RACE cDNA was synthesized from approximately 1 µg of total RNA of *Phaffia rhodozyma* (2 µL) using the SuperScript™ First-Strand Synthesis System for RT-PCR Kit (Invitrogen™ Life Technologies, Carlsbad, Calif.) with the 3' RACE primer (SEQ ID NO:) according to the manufacturer's protocol. After RNase H treatment the cDNA was used as PCR template for generation of a DGAT2-specific gene fragment as follows.

A DGAT2 gene fragment was generated by PCR as follows. The PCR reaction contained 50 mM KCl, 10 mM Tris-HCl (pH 9), 0.1% Triton X-100, 2.5 mM $MgCl_2$, 0.2 mM each dNTP, 5 units of Taq polymerase (MBI Fermentas, USA), 2 µL of *Phaffia rhodozyma* cDNA generated with the 3'RACE primer (SEQ ID NO:211) and PCR primers MWG709 (SEQ ID NO:207) and 3'RACE ABR (SEQ ID NO:212) at a final concentration of 1 µM. Amplification was carried out for 35 cycles, each comprising 45 sec at 94° C., 45 sec at 52° C., and 1 min at 72° C. The resulting PCR reaction was diluted 1000 fold and 5 µL were used in a PCR reaction using 3'RACE ABR primer (SEQ ID NO:212) and MWG 711 (SEQ ID NO:209). A PCR product of approximately 400 bp was excised from agarose gels and sequence directly using primer MWG 711 (SEQ ID NO:209).

5' RACE cDNA was synthesized from 1 µg of total RNA of *Phaffia rhodozyma* (2 µL) using the SuperScript™ First-Strand Synthesis System for RT-PCR Kit (Invitrogen™ Life Technologies, Carlsbad, Calif.) with the MWG712 primer (SEQ ID NO:210) according to the manufacturer's protocol. After RNase H treatment cytidyl residues were added to the 5' end of the synthesized cDNAs using recombinantly produced terminal transferase of calf thymus (New England Biolabs, Beverly, Mass.) according to manufacturer's instructions.

A DGAT2 gene fragment was generated by PCR as follows. The PCR reaction contained 50 mM KCl, 10 mM Tris-HCl (pH 9), 0.1% Triton X-100, 2.5 mM $MgCl_2$, 0.2 mM each dNTP, 5 units of Taq polymerase (MBI Fermentas, USA), 2 µL of *Phaffia rhodozyma* C-tailed cDNA generated with the MWG712 primer (SEQ ID NO:210) and PCR primers 5"RACE P (SEQ ID NO:213) and MWG710 (SEQ ID NO:208) at a final concentration of 1 µM. Amplification was carried out for 35 cycles, each comprising 45 sec at 94° C., 45 sec at 52° C., and 1 min at 72° C. A PCR product of approximately 600 bp was excised from agarose gels and sequence directly using primer MWG710 (SEQ ID NO:208).

Assembly of a cDNA for PR_DGAT2

Sequences derived from PCR products generated from total RNA using RT PCR and degenerate primers and 5' and 3' RACE were assembled using the SEQMAN program of the LASERGENE™ 7.1.1 software package (DNASTAR, INC., USA). This produced a DNA sequence comprised of an ORF of 1218 bp encoding a protein of 405 amino acids. Nucleotide sequence and deduced amino acid sequence of this ORF which are referred to as PR_DGAT2_RACE and PR_DGAT2 PRO are set forth as SEQ ID NO:214 and SEQ ID:215. Based on a CLUSTALW alignment the deduced amino acid sequence of PR_DGAT2_RACE shares 60.2% sequence identity to a hypothetical protein product from *Cryptococcus neoformans* var. *neoformans* B-3501A with GENBANK accession number XP_774736 in a CLUSTALW alignment. This represents the protein with the closest similarity in the curated fungal protein database of NCBI. It has been annotated as having similarity to acyltransferases involved in phospholipid biosynthesis and other proteins of unknown function.

Example 25

Cloning and Sequencing of DGAT2 from *Cryptococcus curvatus*

RNA Isolation and cDNA Synthesis

*Cryptococcus curvatus* (ATCC 10567) was purchased from the American Type Culture Collection (VA, USA). A liquid culture (50 mL, YPD medium) of *Cryptococcus curvatus* was grown at 28° C. Cells were harvested by centrifugation washed with deonized water and collected again by centrifugation. Total RNA was isolated from the resulting cell culture pellet using the hot phenol method exactly as described in Current Protocols in Molecular Biology (John Wiley & Sons, Somerset, N.J.) but where all reagent volumes were increased by 10-fold (e.g. cell pellet was re-suspended in 4 mL of TES solution instead of 400 µL). The final RNA pellet was dissolved in 1 mL of water and the concentration was determined to be 500 ng/µL. cDNA was synthesized from 1 µg of total RNA (2 µL) using the SuperScript™ First-Strand Synthesis System for RT-PCR Kit (Invitrogen™ Life Technologies, Carlsbad, Calif.) with the provided oligo(dT) primer according to the manufacturer's protocol. After RNase H treatment the cDNA was used as PCR template for generation of a DGAT2-specific gene fragment as follows.

Generation of a DGAT2 Specific Probe Using PCR

A DGAT2 gene fragment was generated by PCR as follows. The PCR reaction contained 50 mM KCl, 10 mM Tris-HCl (pH 9), 0.1% Triton X-100, 2.5 mM $MgCl_2$, 0.2 mM each dNTP, 5 units of Taq polymerase (MBI Fermentas, USA), 2 µL of *Cryptococcus curvatus* cDNA and PCR primers P7 (SEQ ID NO:107) and P8 (SEQ ID NO:108) at a final concentration of 1 µM. Amplification was carried out for 35 cycles, each comprising 45 sec at 94° C., 45 sec at 52° C., and 1 min at 72° C. A PCR product of approximately 270 bp was excised from agarose gels, cloned and sequenced using standard techniques. One plasmid clones were identified that contained a cloned PCR product of 269 bp. The nucleotide and deduced amino acid sequence of this PCR product are set forth as SEQ ID NO:216 and SEQ ID NO:217. A BLASTP search of the annotated fungal protein database at NCBI was conducted. Based on a CLUSTALW alignment, the deduced amino acid sequence of the PCR product shares 73.0% sequence identity to a hypothetical protein product from *Cryptococcus neoformans* var. *neoformans* B-3501A with GENBANK accession number XP_774736 which represents the protein with the closest similarity in this database. This protein has been annotated as having similarity to acyltransferases involved in phospholipid biosynthesis and other proteins of unknown function.

Genomic DNA Isolation

A liquid culture (50 mL, YPD medium) of *Cryptococcus curvatus* was grown at 28° C. for 72 h, at 250 rpm. Yeast cells were collected by centrifugation and washed in deionized water. Yeast cells were resuspended in 2 mL of STE buffer (0.1 M sorbitol, 10 mM Tris/HCl, pH 7.5, 1 mM EDTA) containing 10 mg $mL^{-1}$ of Zymolase (Zymo Research Corporation, California, USA) and incubated for 2 hours at 37° C. Total genomic DNA was isolated from *Cryptococcus curvatus* spheroplasts as follows. The yeast suspension was lysed in 4 mL of Urea Extraction buffer (0.3125 M NaCl, 50 mM Tris HCl, pH 8.0, 20 mM EDTA, 1% sarkosine) and equal volume of phenol /chloroform was added followed by thorough mixing. After centrifugation the aqueous phase was re-extracted with phenol chloroform. Nucleic acids were precipitated by addition of 1/8 volume of 4.4 M sodium acetate and 1 volume of isopropanol followed by centrifugation. Nucleic acid were dried and resuspended in 500 microL TE (10 mM Tris, 1 mM EDTA). A small aliquot (1 microL) of the nucleic acid solution was separated on 0.4% agarose gels next to molecular weight marker to confirm that molecular weight was ≧50 kb.

Cosmid Library Construction

Genomic DNA of *Cryptococcus curvatus* was partially digested with MboI. Briefly, approximately 10 µg of genomic DNA were digested with 0.5 units of MboI (NEB, USA) in a final volume of 100 µL in the presence of 0.1 mg $mL^{-1}$ BSA, and 0.1 mg $mL^{-1}$ DNAse-free RNAse (Quiagen, USA) 100 mM NaCl, 50 mM Tris-HCl, 10 mM $MgCl_2$, 1 mM DTT, pH 7.9. Aliquots of 25 µL were removed after 30, 60, 120 and 180 seconds respectively and combined in a tube that contained 5 µL of 500 mM EDTA. The partially digested DNA was purified and concentrated to a final volume of 10 µL using DNA Clean and Concentrator™ spin columns (Zymoresearch, USA) according to instructions of the manufacturer. The DNA was ligated to 2 µg of linearized pLAFR3DNA (B. Staskawicz et al., Journal of bacteriology (1987), 169(12), 5789-94) that had been completely digested with BamHI and dephosphorylated with Antarctic Phosphatase (NEB, USA). The ligation reaction was invitro-packaged and transfected into *E. coli* cells of strain NM554 (Stratagene, USA) using MAXPLAX packaging extracts (EPICENTRE Biotechnologies, USA) according to instructions of the manufacturer. Transfected cells were added to 15 mL of LB medium, incubated at 37° C. on Lab shaker set to 250 rpm. Glycerol was added to a final concentration of 15% (w/w) and the cell suspension was frozen using a dry ice methanol mixture. The titer of the cosmid library was determined by plating serial dilutions of the thawed cell suspension on solidified LB medium containing 10 mg L$^{-1}$ of tetracycline.

Screening and Sequencing of Cosmids Comprising *Cryptococcus curvatus* DGAT2

Approximately 20,000 cosmid clones were plated on selective media, transferred to Biodyne B membranes (PALL Corporation, USA) and screened with a $^{32}$P labeled probe corresponding to the cloned DGAT2-related PCR product of SEQ ID NO:216 derived from *Cryptococcus curvatus* according to standard protocols. Cesium chloride density gradient centrifugation was used as described in T. Maniatis et al. Molecular Cloning: A Laboratory Manual. (1982), 545 pp., was used to purify cosmid DNA from liquid cultures derived from colonies that hybridized to the probe under stringent conditions. Four cosmid clones were sequenced using eight primers with SEQ ID NOs 218 through 225 (Table 48). Sequences were assembled using the SEQMAN program of the LASERGENE™ 7.1.1 software package (DNASTAR, INC., USA ). DNA sequencing of seven independently isolated cosmids with said primers produced DNA sequences that could be assembled into a single sequence of 2816 bp referred to as CC_DGAT2 gene set forth as SEQ ID NO:226. A TBLASTX search of the annotated fungal protein database at NCBI was conducted with the CC_DGAT2 gene (SEQ ID NO:226) which showed similarities to hypothetical fungal proteins with similarities to acyltransferases. At also revealed that the CC_DGAT2 qene is interrupted by several introns.

TABLE 48

Primers used for sequencing of DGAT2 cosmid clones derived from *Cryptococcus curvatus*

| Name | Sequence | SEQ ID NO: |
|---|---|---|
| MWG732 | GGCATGGGAGCTGTCGCGGCCTTTGCGTCCGAGGC | 218 |
| MWG733 | GCCTCGGACGCAAAGGCCGCGACAGCTCCCATGCC | 219 |
| MWG734 | CCTGGCCAAGGGTCCGGGCTATGCCATCACC | 220 |
| MWG735 | GGTGATGGCATAGCCCGGACCCTTGGCCAGG | 221 |
| MWG743 | GCGGCGTGCGGTTGTGGTCGTACCCGGCCC | 222 |
| MWG744 | CCCAGATCATGTACGGGATGAGCACTGGC | 223 |
| MWG745 | CCTTCCGCCACCCCATCGTCACTGTCG | 224 |
| MWG746 | CGCTCTTCCACGGGCGCGGGCTCTTCAAC | 225 |

Example 26

Cloning and Sequencing of DGAT2 from *Mucor circinelloides*

RNA Isolation and cDNA Synthesis

*Mucor circinelloides* (ATCC 1216b) was purchased from the American Type Culture Collection (VA, USA). A liquid culture (50 mL of potato dextrose broth) of *Mucor circinelloides* was grown at 24° C. Potato dextrose broth was purchased from from Becton, Dickinson and Company (NJ, USA). The mycelium was harvested by centrifugation washed with deionized water and collected again by centrifugation. Total RNA was isolated from the resulting mycelium using the hot phenol method exactly as described in Current Protocols in Molecular Biology (John Wiley & Sons, Somerset, N.J.) but where all reagent volumes were increased by 10-fold (e.g. cell pellet was re-suspended in 4 mL of TES solution instead of 400 μL). The final RNA pellet was dissolved in 1 mL of water and the concentration was determined to be 500 ng/uL. cDNA was synthesized from 1 μg of total RNA (2 μL) using the SuperScript™ First-Strand Synthesis System for RT-PCR Kit (Invitrogen™ Life Technologies, Carlsbad, Calif.) with the provided oligo(dT) primer according to the manufacturer's protocol. After RNase H treatment the cDNA was used as PCR template for generation of a DGAT2-specific gene fragment as follows.

Generation of a DGAT2 Specific Probe Using PCR

A DGAT2 gene fragment was generated by PCR as follows. The PCR reaction contained 50 mM KCl, 10 mM Tris-HCl (pH 9), 0.1% Triton X-100, 2.5 mM MgCl$_2$, 0.2 mM each dNTP, 5 units of Taq polymerase (MBI Fermentas, USA), 2 μL of *Mucor circinelloides* cDNA and PCR primers BM DGAT2 FWD (SEQ ID NO:) and BM DGAT2 REV (SEQ ID NO:) at a final concentration of 1 μM. Amplification was carried out for 35 cycles, each comprising 45 sec at 94° C., 45 sec at 52° C., and 1 min at 72° C. A PCR product of approximately 400 bp was excised from agarose gels, cloned and sequenced using standard techniques. One plasmid clones were identified that contained a cloned PCR product of 394 bp. The nucleotide and deduced amino acid sequence of this PCR product are set forth as SEQ ID NO:227 and SEQ ID NO:228. A BLASTP search of the annotated fungal protein database at NCBI was conducted. The deduced amino acid sequence of the PCR product shares 67.2% sequence identity in a CLUSTALW alignment to a hypothetical protein product from *Cryptococcus neoformans* var. *neoformans* B-3501A with GENBANK accession number XP_774736 which represents the protein with the closest similarity in the curated fungal protein database at NCBI. This protein has been annotated as having similarity to acyltransferases involved in phospholipid biosynthesis and other proteins of unknown function.

TABLE 49

Primers used for 3' and 5' RACE amplification of the DGAT2 transcript derived from *Mucor circinelloides*

| Name | Sequence | SEQ ID NO: |
|---|---|---|
| MWG736 | GCAGTTTTGCTAGTTTTGCTACGGAAGC | 229 |
| MWG737 | GCTTCCGTAGCAAAACTAGCAAAACTGC | 230 |
| MWG738 | GAGATTAGGTTTCATCCGAATCGCGATTCGTC | 231 |
| MWG739 | GACGAATCGCGATTCGGATGAAACCTAATCTC | 232 |
| 3'RACE | GGCCACGCGTCGACTAGTACTTTTTTTTTTTTT | 211 |
| 3'RACE ABR | GGCCACGCGTCGACTAGTAC | 212 |
| 5'RACE | P GGCCACGCGTCGACTAGTACGGGXXGGGXXGGGXXG | 213 |

Symbol (Meaning): R (G or A), Y (T or C), M (A or C), K (G or T), S (G or C), W (A or T), H (A or C or T), B (G or T or C), V (G or C or A), O (G or A or T), N (G or A or T or C), and X (Inosine)

3' RACE cDNA was synthesized from 1 μg of total RNA of *Mucor circinelloides* (2 μL) using the SuperScript™ First-Strand Synthesis System for RT-PCR Kit (Invitrogen™ Life Technologies, Carlsbad, Calif.) with the 3'RACE primer (SEQ ID NO:) according to the manufacturer's protocol. After RNase H treatment the cDNA was used as PCR template for generation of a DGAT2-specific gene fragment as follows.

A DGAT2 gene fragment was generated by PCR as follows. The PCR reaction contained 50 mM KCl, 10 mM Tris-HCl (pH 9), 0.1% Triton X-100, 2.5 mM MgCl$_2$, 0.2 mM each dNTP, 5 units of Taq polymerase (MBI Fermentas, USA), 2 µL of *Mucor circinelloides* cDNA generated with the 3'RACE primer (SEQ ID NO:211) and PCR primers MWG736 (SEQ ID NO:229) and 3'RACE ABR primer (SEQ ID NO:212) at a final concentration of 1 µM. Amplification was carried out for 35 cycles, each comprising 45 sec at 94° C., 45 sec at 52° C., and 1 min at 72° C. A prominent PCR product of approximately 650 bp was excised form agarose gels and directly sequenced with the MWG736 (SEQ ID NO:229) and MWG738 (SEQ ID NO:231) primers.

5' RACE cDNA was synthesized from 1 µg of total RNA of *Mucor circinelloides* (2 µL) using the SuperScript™ First-Strand Synthesis System for RT-PCR Kit (Invitrogen™ Life Technologies, Carlsbad, Calif.) with the MWG739 primer (SEQ ID NO:232) according to the manufacturer's protocol. After RNase H treatment cytidyl residues were added to the 5' end of the synthesized cDNAs using recombinantly produced terminal transferase of calf thymus (New England Biolabs, Beverly, Mass.) according to manufacturer's instructions.

A DGAT2 gene fragment was generated by PCR as follows. The PCR reaction contained 50 mM KCl, 10 mM Tris-HCl (pH 9), 0.1% Triton X-100, 2.5 mM MgCl$_2$, 0.2 mM each dNTP, 5 units of Taq polymerase (MBI Fermentas, USA), 2 µL of *Mucor* circinelloides C-tailed cDNA generated with the MWG739 primer (SEQ ID NO:232) and PCR primers 5'RACE P (SEQ ID NO:213) and MWG737 (SEQ ID NO:230) at a final concentration of 1 µM. Amplification was carried out for 35 cycles, each comprising 45 sec at 94° C., 45 sec at 52° C., and 1 min at 72° C. A PCR product of approximately 600 bp was excised from agarose gels and cloned into a plasmid vector. Two plasmid clones with an insert of approximately 520 bp were sequenced completely.

Assembly of a cDNA for MC_DGAT2

DNA sequences derived from PCR products generated from total RNA using RT PCR and degenerate primers and 5' and 3' RACE were assembled using the SEQMAN program of the LASERGENE™ 7.1.1 software package (DNASTAR, INC., USA). This produced a DNA sequence comprised of an ORF of 1110 bp encoding a protein of 369 amino acids. Nucleotide sequence and deduced amino acid sequence of this ORF referred to as MC_DGAT2 are set forth as SEQ ID NO:233 and SEQ ID:234. Based on a CLUSTALW alignment, the deduced amino acid sequence of MC_DGAT2 shares 49.7% sequence identity to a hypothetical protein product from *Ustilago* maydis 521 with GENBANK accession number XP_760084 which represents the protein with the closest similarity in the curated fungal protein database at NCBI. This protein has been annotated as having similarity to acyltransferases involved in phospholipid biosynthesis and other proteins of unknown function. The protein also shares 54.4 and 59.7% sequence identity to the DGAT2a and DAGT2b proteins of *Mortierella* ramanniana described in Lardizabal et al (The Journal of biological chemistry (2001), 276(42), 38862-9.)

Example 27

Expression of DGAT2s from *Yarrowia lipolyitica*, *Torulospora delbrueckii* and *Debaryomyces hansenii* in Soybean Somatic Embryos The present example describes construction of pKR1324, comprising Torulospora diacylglyceride acyltransferase 2a (TD_DGAT2a); pKR1325, comprising Torulospora diacylglyceride acyltransferase 2b (TD_DGAT2b); and pKR1328, comprising Debaryomyces diacylglyceride acyltransferase 2 (DH_DGAT2) and expression in somatic embryos. Control vector pKR1256 (SEQ ID NO:98; Example 16), comprising *Yarrowia* DGAT2, was also expressed for comparison.

Construction of pKR1324, Comprising TD DGAT2a

TD DGAT2a (SEQ ID NO:121) was amplified from a Torulospora cosmid clone described in Example 18 with oligonucleotide primers ocgDG2a-1 (SEQ ID NO:235) and ocgDG2a-2 (SEQ ID NO:236), using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1295 (SEQ ID NO:237). The nucleotide and corresponding amino acid sequence of TD DGAT2a from pKR1295 is set forth in SEQ ID NO:133 and SEQ ID NO:135.

The NotI fragment of pKR1295 (SEQ ID NO:237), containing TD DGAT2a, was cloned into the NotI site of pKR72 (SEQ ID NO:26; Example 4) to produce pKR1324 (SEQ ID NO:238).

Construction of pKR1325, Comprising TD DGAT2b

TD DGAT2b (SEQ ID NO:134) was amplified from Torulospora cosmid DNA described in Example 18 with oligonucleotide primers ocgDG2b-1 (SEQ ID NO:239) and ocgDG2b-2 (SEQ ID NO:240), using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1296 (SEQ ID NO:241). The nucleotide and corresponding amino acid sequence of TD DGAT2b from pKR1296 is set forth in SEQ ID NO:134 and SEQ ID NO:136.

The NotI fragment of pKR1296 (SEQ ID NO:241), containing TD DGAT2b, was cloned into the NotI site of pKR72 (SEQ ID NO:26; Example 4) to produce pKR1325 (SEQ ID NO:242).

Construction of pKR1328, Comprising DH DGAT2

DH DGAT2 (SEQ ID NO:161) was amplified from a Debaryomyces cosmid DNA clone described in Example 20 with oligonucleotide primers odhDG2-1 (SEQ ID NO:243) and odhDG2-2 (SEQ ID NO:244), using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1297 (SEQ ID NO:245). The nucleotide and corresponding amino acid sequence of DH DGAT2 from pKR1297 is set forth in SEQ ID NO:161 and SEQ ID NO:162.

The NotI fragment of pKR1297 (SEQ ID NO:245), containing DH DGAT2, was cloned into the NotI site of pKR179 (SEQ ID NO:246), which is described in BB1574 US 20080095915 (the contents of which are incorporated by reference) to produce pKR1327 (SEQ ID NO:247).

The PstI fragment of pKR1327 (SEQ ID NO:247), containing DH DGAT2, was cloned into the SbfI site of pKR325 (SEQ ID NO:248), previously described in PCT Publication No. WO 2006/012325 (the contents of which are hereby incorporated by reference) to produce pKR1328 (SEQ ID NO:249).

Expression of TD DGAT2a. TD DGAT2b and DH DGAT2 in soy somatic embrvos Soybean embryogenic suspension culture (cv. Jack) was transformed with pKR1324 (SEQ ID NO:238), having experiment number MSE2268; with pKR1325 (SEQ ID NO:242), having experiment number MSE2269 and with pKR1328 (SEQ ID NO:249), having experiment number MSE2270. Control vector pKR1256 (SEQ ID NO:98; Example 16), comprising *Yarrowia* DGAT2, was also transformed alone in a similar way for a control and has experiment number MSE2267. Events were selected and somatic embryos matured in SHaM as described in Example 5. Oil concentrations and fatty acid profiles were determined as described in Example 5 for MSE2267, MSE2268, MSE 2269 and MSE2270 and results for each experiment are shown in Table 50, Table 51, Table 52 and Table 53, respectively.

TABLE 50

Oil concentrations and fatty acid profiles for events from MSE2267 MSE2267 (YL DGAT2)

| Event | 16:0 | 18:0 | 18:1 | 18:2 | 18:3 | % Oil |
|---|---|---|---|---|---|---|
| 2267-13 | 14.4 | 7.2 | 33.1 | 36.8 | 8.6 | 10.6 |
| 2267-16 | 12.9 | 7.5 | 34.9 | 35.9 | 8.9 | 10.2 |
| 2267-21 | 13.9 | 8.2 | 33.5 | 35.3 | 9.1 | 9.6 |
| 2267-26 | 12.3 | 8.9 | 33.2 | 36.8 | 8.8 | 9.6 |
| 2267-8 | 15.9 | 8.3 | 25.6 | 37.4 | 12.7 | 9.0 |
| 2267-18 | 14.5 | 7.7 | 31.1 | 36.1 | 10.6 | 8.4 |
| 2267-19 | 15.4 | 7.5 | 24.4 | 40.5 | 12.2 | 8.2 |
| 2267-5 | 15.5 | 7.4 | 24.5 | 40.8 | 11.7 | 8.1 |
| 2267-30 | 14.3 | 6.4 | 27.3 | 39.2 | 12.8 | 8.0 |
| 2267-4 | 15.4 | 6.4 | 22.0 | 43.4 | 12.8 | 7.8 |
| 2267-9 | 16.7 | 8.0 | 25.8 | 36.2 | 13.3 | 7.7 |
| 2267-31 | 15.8 | 8.6 | 27.6 | 36.3 | 11.7 | 7.7 |
| 2267-20 | 15.2 | 7.2 | 27.1 | 38.1 | 12.4 | 7.6 |
| 2267-24 | 16.7 | 7.8 | 23.9 | 40.7 | 10.9 | 7.5 |
| 2267-15 | 16.6 | 7.6 | 22.2 | 41.8 | 11.8 | 7.4 |
| 2267-3 | 15.8 | 8.1 | 29.3 | 36.2 | 10.6 | 7.4 |
| 2267-29 | 14.8 | 9.0 | 28.8 | 35.5 | 11.9 | 7.3 |
| 2267-25- | 16.3 | 8.9 | 26.1 | 36.2 | 12.5 | 7.1 |
| 2267-10 | 15.8 | 8.3 | 25.8 | 36.9 | 13.2 | 7.0 |
| 2267-14 | 17.2 | 6.6 | 17.9 | 44.2 | 14.1 | 6.9 |
| 2267-17 | 16.9 | 7.1 | 22.1 | 41.3 | 12.6 | 6.9 |
| 2267-23 | 17.3 | 5.8 | 18.4 | 41.7 | 16.7 | 6.6 |
| 2267-22 | 16.8 | 7.9 | 24.2 | 38.3 | 12.8 | 6.5 |
| 2267-11 | 15.3 | 5.0 | 20.6 | 47.8 | 11.3 | 6.5 |
| 2267-28 | 17.2 | 7.2 | 21.6 | 39.6 | 14.4 | 6.3 |
| 2267-7 | 15.0 | 7.9 | 27.2 | 37.5 | 12.4 | 5.8 |
| 2267-12 | 18.1 | 5.9 | 19.0 | 42.1 | 15.0 | 5.7 |
| 2267-6 | 16.5 | 5.9 | 19.7 | 40.2 | 17.7 | 5.4 |
| 2267-27 | 16.0 | 6.7 | 18.8 | 40.8 | 17.6 | 5.0 |
| 2267-2 | 18.3 | 7.6 | 23.3 | 35.6 | 15.3 | 4.6 |
| 2267-1 | 18.6 | 5.7 | 17.7 | 41.4 | 16.6 | 4.6 |
| Avg. | 15.9 | 7.4 | 25.1 | 39.1 | 12.7 | 7.3 |

TABLE 51

Oil concentrations and fatty acid profiles for events from MSE2268 MSE2268 (TD DGAT2a)

| Event | 16:0 | 18:0 | 18:1 | 18:2 | 18:3 | % Oil |
|---|---|---|---|---|---|---|
| 2268-1 | 15.3 | 6.0 | 23.2 | 44.2 | 11.3 | 9.6 |
| 2268-30 | 16.7 | 5.2 | 19.5 | 45.5 | 13.0 | 9.3 |
| 2268-23 | 15.2 | 7.4 | 23.9 | 42.3 | 11.3 | 9.0 |
| 2268-4 | 15.3 | 5.4 | 22.8 | 43.6 | 12.8 | 8.8 |
| 2268-13 | 15.2 | 6.8 | 25.1 | 41.4 | 11.5 | 8.8 |
| 2268-21 | 16.0 | 7.0 | 22.6 | 41.5 | 12.9 | 8.3 |
| 2268-26 | 15.8 | 7.2 | 22.4 | 41.6 | 13.1 | 7.7 |
| 2268-27 | 16.5 | 5.0 | 18.4 | 45.9 | 14.3 | 7.4 |
| 2268-6 | 15.7 | 7.5 | 24.0 | 40.4 | 12.4 | 7.4 |
| 2268-16 | 16.6 | 6.5 | 22.6 | 40.3 | 14.0 | 7.4 |
| 2268-8 | 16.4 | 6.6 | 22.2 | 42.5 | 12.2 | 7.0 |
| 2268-2 | 16.6 | 5.0 | 16.8 | 45.3 | 16.2 | 6.6 |
| 2268-18 | 16.0 | 5.4 | 20.0 | 43.7 | 14.8 | 6.5 |
| 2268-14 | 16.5 | 5.8 | 19.5 | 42.4 | 15.8 | 6.5 |
| 2268-12 | 16.6 | 6.5 | 21.4 | 41.1 | 14.5 | 6.4 |
| 2268-10 | 16.5 | 6.8 | 22.6 | 40.2 | 13.9 | 6.3 |
| 2268-19 | 17.3 | 6.7 | 22.7 | 40.3 | 13.0 | 6.2 |
| 2268-20 | 16.8 | 7.5 | 20.8 | 41.9 | 13.0 | 6.2 |
| 2268-28 | 16.5 | 6.5 | 18.6 | 44.7 | 13.6 | 6.1 |
| 2268-11 | 15.7 | 5.8 | 21.0 | 41.2 | 16.3 | 5.6 |
| 2268-7 | 16.2 | 6.7 | 22.5 | 39.9 | 14.7 | 5.6 |
| 2268-22 | 15.8 | 7.1 | 25.0 | 37.4 | 14.6 | 5.5 |
| 2268-3 | 17.2 | 6.8 | 20.4 | 41.2 | 14.3 | 5.5 |
| 2268-29 | 15.8 | 7.0 | 24.2 | 38.6 | 14.4 | 5.4 |
| 2268-15 | 16.6 | 6.6 | 23.1 | 39.5 | 14.2 | 5.3 |
| 2268-5 | 17.1 | 6.6 | 20.1 | 41.8 | 14.4 | 5.2 |
| 2268-17 | 16.6 | 5.0 | 18.2 | 42.6 | 17.6 | 5.0 |
| 2268-25 | 17.7 | 5.7 | 17.5 | 41.1 | 18.0 | 4.6 |
| 2268-24 | 18.6 | 5.4 | 17.7 | 41.1 | 17.3 | 4.4 |
| 2268-31 | 18.0 | 5.9 | 21.0 | 37.6 | 17.6 | 3.6 |
| 2268-9 | 18.7 | 5.6 | 17.2 | 40.2 | 18.3 | 3.5 |
| Avg. | 16.5 | 6.3 | 21.2 | 41.7 | 14.4 | 6.5 |

TABLE 52

Oil concentrations and fatty acid profiles for events from MSE2269 MSE2269 (TD DGAT2b)

| Event | 16:0 | 18:0 | 18:1 | 18:2 | 18:3 | % Oil |
|---|---|---|---|---|---|---|
| 2269-20 | 15.2 | 5.2 | 20.0 | 48.5 | 11.1 | 10.8 |
| 2269-15 | 15.0 | 6.0 | 21.1 | 45.1 | 12.7 | 9.6 |
| 2269-4 | 14.4 | 5.4 | 21.9 | 46.5 | 11.8 | 9.6 |
| 2269-17 | 15.8 | 5.3 | 21.9 | 45.7 | 11.3 | 9.5 |
| 2269-14 | 16.2 | 5.8 | 20.1 | 44.7 | 13.3 | 8.5 |
| 2269-27 | 16.3 | 5.6 | 20.1 | 45.6 | 12.4 | 8.3 |
| 2269-6 | 16.4 | 4.7 | 18.0 | 46.4 | 14.5 | 8.1 |
| 2269-24 | 16.2 | 5.9 | 21.8 | 43.0 | 13.1 | 8.0 |
| 2269-16 | 16.6 | 6.5 | 18.9 | 43.9 | 14.2 | 7.8 |
| 2269-11 | 15.7 | 7.7 | 25.0 | 39.5 | 12.1 | 7.8 |
| 2269-13 | 15.9 | 6.1 | 23.3 | 41.6 | 13.1 | 7.6 |
| 2269-19 | 16.2 | 5.9 | 21.4 | 43.0 | 13.6 | 7.4 |
| 2269-7 | 16.1 | 5.3 | 20.2 | 43.6 | 14.8 | 7.3 |
| 2269-1 | 16.4 | 7.1 | 24.7 | 39.1 | 12.8 | 7.2 |
| 2269-26 | 16.7 | 5.0 | 19.6 | 43.5 | 15.1 | 7.0 |
| 2269-10 | 17.0 | 5.3 | 17.7 | 43.9 | 16.1 | 6.6 |
| 2269-21 | 16.3 | 7.0 | 23.6 | 38.3 | 14.8 | 6.6 |
| 2269-18 | 16.7 | 5.7 | 19.7 | 42.8 | 15.1 | 6.5 |
| 2269-3 | 17.0 | 5.4 | 19.6 | 41.4 | 16.7 | 6.1 |
| 2269-5 | 17.6 | 5.0 | 17.9 | 43.4 | 16.1 | 6.0 |
| 2269-28 | 17.3 | 6.6 | 17.6 | 43.2 | 15.3 | 5.6 |
| 2269-8 | 16.7 | 4.8 | 18.3 | 43.5 | 16.7 | 5.4 |
| 2269-25 | 16.4 | 4.9 | 16.9 | 45.1 | 16.6 | 5.1 |
| 2269-23 | 17.9 | 5.6 | 18.1 | 41.5 | 17.0 | 5.1 |
| 2269-9 | 16.6 | 5.4 | 17.9 | 42.4 | 17.6 | 4.9 |
| 2269-31 | 17.0 | 5.6 | 16.4 | 43.5 | 17.6 | 4.8 |
| 2269-2 | 18.0 | 4.3 | 14.6 | 42.3 | 20.8 | 3.5 |
| 2269-22 | 18.8 | 5.4 | 15.6 | 40.9 | 19.3 | 3.5 |
| 2269-12 | 18.1 | 5.4 | 15.4 | 42.3 | 18.8 | 3.3 |
| 2269-30 | 19.1 | 4.8 | 15.0 | 41.1 | 20.0 | 3.1 |
| 2269-29 | 19.2 | 4.9 | 14.3 | 42.9 | 18.7 | 2.9 |
| Avg. | 16.7 | 5.6 | 19.2 | 43.2 | 15.3 | 6.6 |

TABLE 53

Oil concentrations and fatty acid profiles for events from MSE2270 MSE2270 (DH DGAT2)

| Event | 16:0 | 18:0 | 18:1 | 18:2 | 18:3 | % Oil |
|---|---|---|---|---|---|---|
| 2270-22 | 15.7 | 4.8 | 20.7 | 47.1 | 11.7 | 10.6 |
| 2270-20 | 15.5 | 4.9 | 20.4 | 46.3 | 12.9 | 9.5 |
| 2270-8 | 16.7 | 5.2 | 20.5 | 44.6 | 13.0 | 8.9 |
| 2270-29 | 17.1 | 5.6 | 19.6 | 41.8 | 15.9 | 8.1 |
| 2270-30 | 15.9 | 6.2 | 23.5 | 41.8 | 12.6 | 7.9 |
| 2270-21 | 16.9 | 5.5 | 19.8 | 41.8 | 16.0 | 7.2 |
| 2270-2 | 17.0 | 5.6 | 20.6 | 42.2 | 14.6 | 7.1 |
| 2270-20 | 16.7 | 5.7 | 21.4 | 42.1 | 14.1 | 7.1 |
| 2270-2 | 16.9 | 5.9 | 19.2 | 42.9 | 15.1 | 6.7 |
| 2270-4 | 16.8 | 6.9 | 20.5 | 40.6 | 15.2 | 6.6 |
| 2270-27 | 16.0 | 6.2 | 21.5 | 42.1 | 14.2 | 6.3 |
| 2270-26 | 16.4 | 5.6 | 20.4 | 42.0 | 15.7 | 6.2 |
| 2270-9 | 16.3 | 4.7 | 17.7 | 44.7 | 16.5 | 6.2 |
| 2270-28 | 17.1 | 4.8 | 17.7 | 44.2 | 16.2 | 6.0 |
| 2270-21 | 18.6 | 5.8 | 16.9 | 41.3 | 17.4 | 5.6 |
| 2270-26 | 18.7 | 5.3 | 18.2 | 39.5 | 18.2 | 5.3 |
| 2270-22 | 17.4 | 6.2 | 18.6 | 39.2 | 18.5 | 5.1 |
| 2270-23 | 19.5 | 4.7 | 17.0 | 42.3 | 16.5 | 4.9 |
| 2270-24 | 19.4 | 5.0 | 15.2 | 42.1 | 18.3 | 4.8 |
| 2270-28 | 16.2 | 5.2 | 20.1 | 45.1 | 13.4 | 4.6 |
| 2270-25 | 16.0 | 8.0 | 20.6 | 39.1 | 16.1 | 4.6 |
| 2270-31 | 18.0 | 5.0 | 16.7 | 41.5 | 18.8 | 4.5 |
| 2270-25 | 17.1 | 5.4 | 18.7 | 40.9 | 17.9 | 4.2 |
| 2270-24 | 13.9 | 5.2 | 16.3 | 45.7 | 18.9 | 4.1 |
| 2270-5 | 18.0 | 6.2 | 20.6 | 38.2 | 16.9 | 4.0 |
| 2270-23 | 19.6 | 4.5 | 15.0 | 40.6 | 20.3 | 4.0 |
| 2270-27 | 17.8 | 5.1 | 16.7 | 41.9 | 18.4 | 3.8 |
| 2270-6 | 17.1 | 5.7 | 16.8 | 41.5 | 18.9 | 3.5 |
| 2270-3 | 18.5 | 5.3 | 17.0 | 40.7 | 18.6 | 3.5 |
| 2270-7 | 17.3 | 4.3 | 14.4 | 40.9 | 23.2 | 3.2 |
| 2270-29 | 18.7 | 4.1 | 12.4 | 40.4 | 24.3 | 2.5 |
| Avg. | 17.2 | 5.4 | 18.5 | 42.1 | 16.7 | 5.7 |

TD_DGAT2a, TD_DGAT2b and DH_DGAT2 increase oil concentrations in somatic embryos to amounts similar to YL_DGAT2. But, in contrast to what is seen for YL_DGAT2 (i.e. increasing oleic acid concentrations, decreasing palmitic acid and alpha-linolenic acid concentrations) effects on fatty acid profiles are not as strong for TD_DGAT2a, TD_DGAT2b and DH_DGAT2.

Example 28

Expression of DGAT2s from *Yarrowia lipolyitica, Mortierella alpina Pichia anomala* and *Rhodotorula glutinis* in Soybean Somatic Embryos The present example describes construction of pKR1335, comprising *Mortierella alpina* diacylglyceride acyltransferase 2 (Ma_DGAT2); pKR1332, comprising *Pichia anomala* diacylglyceride acyltransferase 2 (PA_DGAT2); and pKR1333, comprising *Rhodorurola glutinis* diacylglyceride acyltransferase 2 (RG_DGAT2) and expression in somatic embryos. Control vector pKR1256 (SEQ ID NO:98; Example 16), comprising *Yarrowia* DGAT2, was also expressed for comparison.

Construction of pKR1335, Comprising MA DGAT2

MA_DGAT2 was amplified from pMDGAT2-17 (SEQ ID NO:250), which is described in issued U.S. Pat. No. 7,198,937-CRD MalpinaDGAT2 patent (the contents of which is incorporated by reference) with oligonucleotide primers oMaDG2-3 (SEQ ID NO:251) and oMaDG2-4 (SEQ ID NO:252), using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1330 (SEQ ID NO:253). The nucleotide and corresponding amino acid sequence of MA DGAT2 from pKR1330 is set forth in SEQ ID NO:254 and SEQ ID NO:255.

The NotI fragment of pKR1330 (SEQ ID NO:253), containing MA DGAT2, was cloned into the NotI site of pKR72 (SEQ ID NO:26; Example 4) to produce pKR1335 (SEQ ID NO:256).

Construction of pKR1332, Comprising PA DGAT2

PA DGAT2 (SEQ ID NO:146) was amplified from a *Pichia anomala* cosmid DNA clone described in Example 19 with oligonucleotide primers oTdDG2-1 (PA) (SEQ ID NO:257) and oTdDG2-2 (PA) (SEQ ID NO:258), using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1319 (SEQ ID NO:259). The nucleotide and corresponding amino acid sequence of PA_DGAT2 from pKR1319 is set forth in SEQ ID NO:146 and SEQ ID NO:147

The NotI fragment of pKR1319 (SEQ ID NO:259), containing PA DGAT2, was cloned into the NotI site of pKR72 (SEQ ID NO:26; Example 4) to produce pKR1332 (SEQ ID NO:260).

Construction of pKR1333, Comprising RG DGAT2

Because the RG DGAT2 genomic sequence (SEQ ID NO:204; Example 23) appeared to contain numerous introns when compared to other DGATs by BlastX analysis, the RG DGAT2 coding sequence was cloned by PCR from cDNA and RNA isolation and cDNA synthesis is described below.

Oligonucleotide primers RgCDNA-5 (SEQ ID NO:261) and RgCDNA-3 (SEQ ID NO:262), which were designed based on the genomic DNA sequence of the RG_DGAT2 gene (SEQ ID NO:204; Example 23). Using the Phusion™ High-Fidelity DNA Polymerase (Cat. No. F553S, Finnzymes Oy, Finland) following the manufacturer's protocol the RG_DGAT2 transcript was amplified from cDNA of *Rhodotorula glutinis* that was generated as described in Example 23. The resulting DNA fragment was cloned into the pCR-Blunt® cloning vector using the Zero Blunt® PCR Cloning Kit (Invitrogen Corporation), following the manufacturer's protocol, to produce pHD28 (SEQ ID NO:263). The RG DGAT2 cDNA nucleotide and corresponding amino acid sequences are set forth in SEQ ID NO:264 and SEQ ID NO:265, respectively. A BLASTP search of the annotated fungal protein database at NCBI was conducted. Based on a CLUSTALW aligment, the deduced amino acid sequence of the RG_DGAT2 transcript shares 62.4% sequence identity to a hypothetical protein product from *Ustilago maydis* 521 with GENBANK accession number XP_760084 which represents the protein with the closest similarity in this database. This protein has been annotated as having similarity to acyltransferases involved in phospholipid biosynthesis and other proteins of unknown function.

The NotI fragment of pHD28 (SEQ ID NO:263), containing RG_DGAT2, was cloned into the NotI site of pKR72 (SEQ ID NO:26; Example 4) to produce pKR1333 (SEQ ID NO:266).

Expression of Ma DGAT2, PA DGAT2 and RG DGAT2 in Soy Somatic Embryos

Soybean embryogenic suspension culture (cv. Jack) was transformed with pKR1335 (SEQ ID NO:256), having experiment number MSE2296; with pKR1332 (SEQ ID NO:260), having experiment number MSE2297 and with pKR1333 (SEQ ID NO:266), having experiment number MSE2298. Control vector pKR1256 (SEQ ID NO:98;

Example 16), comprising *Yarrowia* DGAT2, was also transformed alone in a similar way for a control and has experiment number MSE2295. Events were selected and somatic embryos matured in SHaM as described in Example 5. Oil concentrations and fatty acid profiles were determined as described in Example 5 for MSE2295, MSE2296, MSE 2297 and MSE2298 and results for each experiment are shown in Table 54, Table 55, Table 56 and Table 57, respectively.

TABLE 54

Oil concentrations and fatty acid profiles for events from MSE2295 MSE2295 (YL DGAT2)

| Event | 16:0 | 18:0 | 18:1 | 18:2 | 18:3 | % Oil |
|---|---|---|---|---|---|---|
| 2295-7 | 12.3 | 5.5 | 37.0 | 38.1 | 7.1 | 13.4 |
| 2295-26 | 11.9 | 5.7 | 42.1 | 33.6 | 6.7 | 12.8 |
| 2295-4 | 14.0 | 5.1 | 29.0 | 41.5 | 10.4 | 11.4 |
| 2295-15 | 13.0 | 6.5 | 34.0 | 37.3 | 9.1 | 10.0 |
| 2295-2 | 13.9 | 6.2 | 32.6 | 37.6 | 9.7 | 9.7 |
| 2295-14 | 14.1 | 5.1 | 28.5 | 40.6 | 11.7 | 8.8 |
| 2295-10 | 15.9 | 6.1 | 27.8 | 39.1 | 11.2 | 8.6 |
| 2295-8 | 13.9 | 5.9 | 32.4 | 37.7 | 10.2 | 8.2 |
| 2295-5 | 17.1 | 5.7 | 21.3 | 42.8 | 13.1 | 8.0 |
| 2295-1 | 16.6 | 4.4 | 17.3 | 47.9 | 13.8 | 7.9 |
| 2295-18 | 14.3 | 5.5 | 34.0 | 35.5 | 10.8 | 7.6 |
| 2295-24 | 15.5 | 4.8 | 23.6 | 42.7 | 13.4 | 7.2 |
| 2295-23 | 17.0 | 4.9 | 17.4 | 44.9 | 16.0 | 6.6 |
| 2295-17 | 15.6 | 6.8 | 30.5 | 35.4 | 11.7 | 6.6 |
| 2295-20 | 14.1 | 5.6 | 27.6 | 39.2 | 13.5 | 6.5 |
| 2295-25 | 16.3 | 5.2 | 20.4 | 41.9 | 16.0 | 6.3 |
| 2295-13 | 14.7 | 5.6 | 23.5 | 40.9 | 15.3 | 6.3 |
| 2295-16 | 16.9 | 7.2 | 24.4 | 38.4 | 13.1 | 6.2 |
| 2295-6 | 18.4 | 6.1 | 20.9 | 40.0 | 14.6 | 6.1 |
| 2295-21 | 18.1 | 5.2 | 15.1 | 45.5 | 16.1 | 5.9 |
| 2295-22 | 16.4 | 5.1 | 21.2 | 41.7 | 15.6 | 5.9 |
| 2295-3 | 17.9 | 5.5 | 21.3 | 40.3 | 14.9 | 5.8 |
| 2295-19 | 14.2 | 5.0 | 19.9 | 45.1 | 15.9 | 5.6 |
| 2295-9 | 16.3 | 4.5 | 23.4 | 40.9 | 14.9 | 5.2 |
| 2295-11 | 16.6 | 6.1 | 22.4 | 39.1 | 15.8 | 4.5 |
| 2295-12 | 18.3 | 5.0 | 16.3 | 41.7 | 18.7 | 4.3 |
| Avg. | 15.5 | 5.6 | 25.5 | 40.4 | 13.0 | 7.5 |

TABLE 55

Oil concentrations and fatty acid profiles for events from MSE2296 MSE2296 (MA DGAT2)

| Event | 16:0 | 18:0 | 18:1 | 18:2 | 18:3 | % Oil |
|---|---|---|---|---|---|---|
| 2296-26 | 13.4 | 5.3 | 31.5 | 41.8 | 8.0 | 13.4 |
| 2296-14 | 13.4 | 5.9 | 32.6 | 38.9 | 9.2 | 11.6 |
| 2296-23 | 13.9 | 6.0 | 32.5 | 39.5 | 8.1 | 11.0 |
| 2296-4 | 15.5 | 5.4 | 25.4 | 43.1 | 10.6 | 10.9 |
| 2296-17 | 15.4 | 5.2 | 18.9 | 49.1 | 11.4 | 10.8 |
| 2296-6 | 14.5 | 6.7 | 31.9 | 37.5 | 9.3 | 10.3 |
| 2296-24 | 14.3 | 6.1 | 29.6 | 40.5 | 9.5 | 10.1 |
| 2296-16 | 14.6 | 5.8 | 30.0 | 39.3 | 10.3 | 10.0 |
| 2296-19 | 15.5 | 6.3 | 25.6 | 40.5 | 12.0 | 9.4 |
| 2296-12 | 15.1 | 6.0 | 28.6 | 39.8 | 10.6 | 8.6 |
| 2296-22 | 16.4 | 4.4 | 17.1 | 47.9 | 14.3 | 8.5 |
| 2296-20 | 14.9 | 6.6 | 27.2 | 39.9 | 11.5 | 8.3 |
| 2296-13 | 16.4 | 5.5 | 20.2 | 44.6 | 13.3 | 8.2 |
| 2296-11 | 16.0 | 6.0 | 22.8 | 42.0 | 13.2 | 8.2 |
| 2296-3 | 15.2 | 5.6 | 22.8 | 44.4 | 12.0 | 8.2 |
| 2296-1 | 16.2 | 4.7 | 20.5 | 45.6 | 13.2 | 7.8 |
| 2296-18 | 14.9 | 5.1 | 28.2 | 39.4 | 12.3 | 7.5 |
| 2296-9 | 15.9 | 7.8 | 21.1 | 42.5 | 12.6 | 7.4 |
| 2296-15 | 17.1 | 5.1 | 18.8 | 44.3 | 14.7 | 7.4 |
| 2296-10 | 16.5 | 6.7 | 25.0 | 39.7 | 12.2 | 7.3 |
| 2296-5 | 14.2 | 6.7 | 29.1 | 38.3 | 11.7 | 7.2 |
| 2296-25 | 16.5 | 6.1 | 22.1 | 41.4 | 13.8 | 7.0 |
| 2296-21 | 16.4 | 5.8 | 23.6 | 41.2 | 12.9 | 6.4 |
| 2296-8 | 16.8 | 7.1 | 21.7 | 41.5 | 12.9 | 6.3 |
| 2296-27 | 16.5 | 4.6 | 17.5 | 44.1 | 17.4 | 5.8 |
| 2296-7 | 17.6 | 5.9 | 21.6 | 38.1 | 16.8 | 4.9 |
| 2296-2 | 14.3 | 5.4 | 19.4 | 41.3 | 19.6 | 3.5 |
| Avg. | 15.5 | 5.9 | 24.6 | 41.7 | 12.3 | 8.4 |

TABLE 56

Oil concentrations and fatty acid profiles for events from MSE2297 MSE2297 (PA DGAT2)

| Event | 16:0 | 18:0 | 18:1 | 18:2 | 18:3 | % Oil |
|---|---|---|---|---|---|---|
| 2297-23 | 17.0 | 5.8 | 22.1 | 42.1 | 12.9 | 7.2 |
| 2297-10 | 16.5 | 6.3 | 21.6 | 42.2 | 13.3 | 7.2 |
| 2297-21 | 16.5 | 5.1 | 17.1 | 46.9 | 14.4 | 7.0 |
| 2297-1 | 16.4 | 6.7 | 22.9 | 40.8 | 13.2 | 6.7 |
| 2297-15 | 17.2 | 5.4 | 18.8 | 44.5 | 14.0 | 6.4 |
| 2297-22 | 19.6 | 5.0 | 13.5 | 37.8 | 24.1 | 6.2 |
| 2297-18 | 17.3 | 6.9 | 21.9 | 40.3 | 13.6 | 6.0 |
| 2297-17 | 16.2 | 6.6 | 23.7 | 39.7 | 13.7 | 5.9 |
| 2297-5 | 16.8 | 5.5 | 18.6 | 43.7 | 15.4 | 5.9 |
| 2297-3 | 17.4 | 4.8 | 18.9 | 42.3 | 15.6 | 5.7 |
| 2297-6 | 17.0 | 6.1 | 18.8 | 41.9 | 16.2 | 5.6 |
| 2297-13 | 17.1 | 6.0 | 22.5 | 39.0 | 15.3 | 5.5 |
| 2297-16 | 16.9 | 5.8 | 21.0 | 42.3 | 14.0 | 5.5 |
| 2297-11 | 17.1 | 5.2 | 21.1 | 41.2 | 15.4 | 5.4 |
| 2297-20 | 17.0 | 5.9 | 21.9 | 39.5 | 15.6 | 5.4 |
| 2297-25 | 15.8 | 4.6 | 22.0 | 41.1 | 16.5 | 5.3 |
| 2297-24 | 17.0 | 5.6 | 21.7 | 42.5 | 13.1 | 5.2 |
| 2297-9 | 17.3 | 5.3 | 17.9 | 41.3 | 18.2 | 5.1 |
| 2297-14 | 16.7 | 5.4 | 19.6 | 42.6 | 15.7 | 5.1 |
| 2297-7 | 17.0 | 5.0 | 20.7 | 42.0 | 15.3 | 4.8 |
| 2297-4 | 15.9 | 5.1 | 19.7 | 40.8 | 18.6 | 4.6 |
| 2297-12 | 18.7 | 5.3 | 18.7 | 40.3 | 17.0 | 4.5 |
| 2297-26 | 18.5 | 4.8 | 16.8 | 41.1 | 18.7 | 4.3 |
| 2297-8 | 17.5 | 5.2 | 18.6 | 39.5 | 19.2 | 4.2 |
| 2297-19 | 18.0 | 5.0 | 18.0 | 40.6 | 18.4 | 4.2 |
| 2297-2 | 18.5 | 5.9 | 18.3 | 38.2 | 19.0 | 3.5 |
| Avg. | 17.2 | 5.6 | 19.9 | 41.3 | 16.1 | 5.5 |

TABLE 57

Oil concentrations and fatty acid profiles for events from MSE2298 MSE2298 (RG DGAT2)

| Event | 16:0 | 18:0 | 18:1 | 18:2 | 18:3 | % Oil |
|---|---|---|---|---|---|---|
| 2298-8 | 14.7 | 5.0 | 22.6 | 44.4 | 13.2 | 9.4 |
| 2298-16 | 17.1 | 5.4 | 26.2 | 41.1 | 10.3 | 9.4 |
| 2298-11 | 16.5 | 4.8 | 21.0 | 45.0 | 12.7 | 9.2 |
| 2298-21 | 15.8 | 5.4 | 25.0 | 41.5 | 12.3 | 8.5 |
| 2298-24 | 16.4 | 4.8 | 20.9 | 44.1 | 13.7 | 8.2 |
| 2298-5 | 16.4 | 6.0 | 26.9 | 39.5 | 11.2 | 8.2 |
| 2298-4 | 18.3 | 6.5 | 24.2 | 38.8 | 12.2 | 7.9 |
| 2298-22 | 16.5 | 5.6 | 23.2 | 41.5 | 13.1 | 7.6 |
| 2298-2 | 16.6 | 5.8 | 27.1 | 39.2 | 11.4 | 7.4 |
| 2298-14 | 17.2 | 5.9 | 28.0 | 36.3 | 12.6 | 7.4 |
| 2298-18 | 16.8 | 6.0 | 24.4 | 39.8 | 13.0 | 7.3 |
| 2298-19 | 17.2 | 6.3 | 30.0 | 35.3 | 11.2 | 7.2 |
| 2298-23 | 17.0 | 6.7 | 25.8 | 38.3 | 12.2 | 6.8 |
| 2298-10 | 15.2 | 4.5 | 22.4 | 41.6 | 16.4 | 6.7 |
| 2298-3 | 16.9 | 6.5 | 23.3 | 38.9 | 14.3 | 6.3 |
| 2298-6 | 17.2 | 6.0 | 24.3 | 38.4 | 14.0 | 6.0 |
| 2298-7 | 16.3 | 5.1 | 21.9 | 40.4 | 16.3 | 6.0 |
| 2298-17 | 16.5 | 5.3 | 17.5 | 41.7 | 19.0 | 5.9 |
| 2298-20 | 16.6 | 5.9 | 23.2 | 39.5 | 14.8 | 5.5 |
| 2298-9 | 17.1 | 5.2 | 19.5 | 41.7 | 16.5 | 5.5 |
| 2298-12 | 17.8 | 5.1 | 20.4 | 39.2 | 17.5 | 5.2 |
| 2298-13 | 15.7 | 5.1 | 20.4 | 39.8 | 18.9 | 5.1 |
| 2298-1 | 17.6 | 4.8 | 19.0 | 41.6 | 17.0 | 4.9 |
| 2298-15 | 16.7 | 6.1 | 23.3 | 38.2 | 15.7 | 4.4 |
| Avg. | 16.7 | 5.6 | 23.4 | 40.3 | 14.1 | 6.9 |

MA_DGAT2 increases oil and oleic acid concentration in somatic embryos to amounts similar to YL DGAT2. MA_DGAT2 is also similar to YL_DGAT2 in that palmitic acid and alpha-linolenic acid concentrations are decreased. RG DGAT2 has some ability to increase oil and oleic acid concentrations in somatic embryos but the overall effect is less than for either MA DGAT2 or YL DGAT2. PA DGAT2 does not increase oil or oleic acid concentrations in this experiment.

Example 29

Expression of DGAT2s from *Yarrowia lipolyitica* and *Lipomyces starkeyi* in Soybean Somatic Embryos The present example describes construction of pKR1337, comprising *Lipomyces starkeyi* diacylglyceride acyltransferase 2 (LS_DGAT2) and expression in somatic embryos. Control vector pKR1256 (SEQ ID NO:98; Example 16), comprising *Yarrowia* DGAT2, was also expressed for comparison.

Construction of pKR1337, Comprising LS DGAT2

Because the LS DGAT2 genomic sequence (SEQ ID NO:194; Example 22) appeared to contain numerous introns when compared to other DGATs by BlastX analysis, the LS DGAT2 coding sequence was cloned by PCR from cDNA. RNA isolation and cDNA synthesis is described below.

RNA was isolated from *Lipomyces starkeyi* and cDNA was synthesized as described in Example 22. Analysis of the LS DGAT2 genomic sequence (SEQ ID NO:194; Example 22) suggested two potential ORF initiation sites and 5' oligos were constructed to each of these potential ORF initiation sites. Based on the genomic DNA sequence (SEQ ID NO:194; Example 22) and using the first potential initiation site (longer ORF), LS DGAT2 was amplified from the cDNA (2 µL) with oligonucleotide primers Lip5-1 (SEQ ID NO:267) and Lip3 (SEQ ID NO:268), using the Phusion™ High-Fidelity DNA Polymerase (Cat. No. F553S, Finnzymes Oy, Finland) following the manufacturer's protocol. Using the second potential initiation site (slightly shorter ORF), LS DGAT2 was amplified from the cDNA (2 µL) with oligonucleotide primers Lip5-2 (SEQ ID NO:269) and Lip3 (SEQ ID NO:268) in the same way. Only the PCR reaction using the second potential initiation site (Lip5-2 with Lip3) gave a PCR product. The resulting DNA fragment was cloned into the pCR-Blunt® cloning vector using the Zero Blunt® PCR Cloning Kit (Invitrogen Corporation), following the manufacturer's protocol, to produce pHD30 (SEQ ID NO: 270). The LS DGAT2 cDNA nucleotide and corresponding amino acid sequences are set forth in SEQ ID NO:271 and SEQ ID NO:272, respectively. A BLASTP search of the annotated fungal protein database at NCBI was conducted. Based on a CLUSTALW alignment, the deduced amino acid sequence of the LS DGAT2 cDNA shares 51.0% sequence identity to a hypothetical protein product from *Yarrowia lipolytica* CLIB122 with GENBANK accession number XP_504700 which represents the protein with the closest similarity in this database. The amino acid sequence of this protein identical to that of YL DGAT 2 described in PCT Publication No. WO 2005/003322 and differs in one amino acid residue from that of SEQ ID NO:10 for reasons that are outline in Example 1.

The NotI fragment of pHD30 (SEQ ID NO:270), containing LS_DGAT2, was cloned into the NotI site of pKR72 (SEQ ID NO:26; Example 4) to produce pKR1337 (SEQ ID NO:273).

Expression of LS DGAT2 in Soy Somatic Embryos

Soybean embryogenic suspension culture (cv. Jack) was transformed with pKR1337 (SEQ ID NO:273), having experiment number MSE2333. Control vector pKR1256 (SEQ ID NO:98; Example 16), comprising *Yarrowia* DGAT2, was also transformed alone in a similar way for a control and has experiment number MSE2334.

Example 30

Expression of DGAT1s from *Yarrowia lipolytica* and *Mortierella alpina* in Soybean Somatic Embryos The present example describes construction of pKR1334, comprising *Mortierella diacylglyceride* acyltransferase 1 (Ma_DGAT1) and control vector pKR1323, comprising *Yarrowia* DGAT1 codon optimized for expression in soy.

Construction of pKR1334, Comprising MA DGAT1

MA_DGAT1 was amplified from pMDGAT1-17 (SEQ ID NO:274), which is described in issued U.S. Pat. No. 7,273,746 (the contents of which is incorporated by reference) with oligonucleotide primers oMaDG1-1 (SEQ ID NO:275) and oMaDG1-2 (SEQ ID NO:276), using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1329 (SEQ ID NO:277). The MA_DGAT1 nucleotide and corresponding amino acid sequences are set forth in SEQ ID NO:278 and SEQ ID NO:279, respectively.

The NotI fragment of pKR1329 (SEQ ID NO:277), containing MA_DGAT1, was cloned into the NotI site of pKR72 (SEQ ID NO:26; Example 4) to produce pKR1334 (SEQ ID NO:280).

Construction of pKR1323, Comprising YL DGAT1 Codon Optimized for Soy

YL DGAT1 was codon optimized for expression in soy as described in Example 9 and Example 17 and the codon optimized nucleotide sequence is set forth in SEQ ID NO:64. The corresponding amino acid sequence coded for by the codon optimized YL DGAT1 is identical to the wild-type YL DGAT1 amino acid sequence (SEQ ID NO:65). The codon optimized sequence contained two internal ORF of 1023 bp and 687 bp in length in the opposite direction as the coding sequence was and these were not present in the wild-type YL_DGAT1 sequence. In order to remove the internal ORFs, the following cloning steps were carried out.

In order to add appropriate restriction sites, the NotI fragment of KS392 (SEQ ID NO:101, Example 17), containing the codon optimized YL DGAT1, was cloned into the NotI site pBluescript II SK(+) vector (Stratagene), to produce pKR1314 (SEQ ID NO:281).

In order to remove the internal 687 bp ORF, the 5' end of YL DGAT1 was amplified from KS392 (SEQ ID NO:101) with oligonucleotide primers oYIDG1 co-1 (SEQ ID NO:282) and oYIDGlco-2 (SEQ ID NO:283), using the Phusion™ High-Fidelity DNA Polymerase (Cat. No. F553S, Finnzymes Oy, Finland) following the manufacturer's protocol. The 5' end of YL DGAT1 was also amplified from KS392 (SEQ ID NO:101) with oligonucleotide primers oYIDG1 co-3 (SEQ ID NO:284), which is complementary to oYLDG1 co-2 (SEQ ID NO:283) and oYIDG1 co-4 (SEQ ID NO:285), which removes the internal 1023 bp ORF, using the Phusion™ High-Fidelity DNA Polymerase (Cat. No. F553S, Finnzymes Oy, Finland) following the manufacturer's protocol. YL DGAT1 was then amplified from the combined PCR products of the two PCR reactions described above with oligonucleotide primers oYIDG1co-1 (SEQ ID NO:282) and oYIDG-lco-4 (SEQ ID NO:284), using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1310 (SEQ ID NO:286).

The BglII/EcoRV fragment of pKR1314 (SEQ ID NO:281) containing the remaining 3' end of the YL-DGAT1 gene was cloned into the BglII/EcoRV fragment of pKR1310 (SEQ ID NO:286) to produce pKR1316 (SEQ ID NO:287), which contains a full length, codon optimized YL DGAT1 with all internal ORFs removed. The nucleotide sequence for the codon optimized YL DGAT1 having internal ORFs removed, called YL DGAT1cod2, is set forth in SEQ ID NO:288. The amino acid sequence of YL DGAT1 cod2 is identical to the wild-type YL DGAT1 (SEQ ID NO:65).

The NotI fragment of pKR1316 (SEQ ID NO:287), containing YL DGAT1cod2, was cloned into the NotI site of pKR72 (SEQ ID NO:26; Example 4) to produce pKR1323 (SEQ ID NO:289).

Expression of YL DGAT1 cod2 and Ma DGAT1 in Soy Somatic Embryos

Soybean embryogenic suspension culture (cv. Jack) was transformed with pKR1334 (SEQ ID NO:280), having experiment number MSE2332. Control vector pKR1323 (SEQ ID NO:289), comprising YL DGAT1cod2, was also transformed in a similar way and has experiment number MSE2331.

Example 31

Expression of DGAT2s from *Yarrowia lipolyitica* and *Phaffia rhodozyma* in Soybean Somatic Embryos The present example describes construction of pKR1372, comprising *Phaffia rhodozyma* diacylglyceride acyltransferase 2 (PR DGAT2) and expression in somatic embryos. Control vector pKR1256 (SEQ ID NO:98; Example 16), comprising *Yarrowia* DGAT2, was also expressed for comparison.

Construction of pKR1372, Comprising PR DGAT2

Based on the cDNA sequence of PR_DGAT2 RACE (SEQ ID NO:214; Example 24) PR DGAT2 was amplified from the cDNA (2 μL) with oligonucleotide primers PrDGAT2-5 (SEQ ID NO:290) and PrDGAT2-3 (SEQ ID NO:291), using the Phusion™ High-Fidelity DNA Polymerase (Cat. No. F553S, Finnzymes Oy, Finland) following the manufacturer's protocol, to produce pHD37 (SEQ ID NO:292). The insert of pHD37 comprising the DGAT2 gene was sequenced completely. The resulting DNA sequence is referred to as PR_DGAT2. It's nucleotide sequences is set forth as SEQ ID NO:293. There are eight differences at the nucleotide level between PR_DGAT2 RACE (SEQ ID NO:214) and PR_DGAT2 (SEQ ID NO:293) nucleotide sequences however the amino acid sequences that can be deduced from both sequences are identical. The amino acid sequence of PR_DGAT2 is set forth as (SEQ ID NO:215).

The NotI fragment of pHD37 (SEQ ID NO:292), containing PR_DGAT2, was cloned into the NotI site of pKR72 (SEQ ID NO:26; Example 4) to produce pKR1372 (SEQ ID NO:294).

Expression of PR DGAT2 in Soy Somatic Embryos

Soybean embryogenic suspension culture (cv. Jack) was transformed with pKR1372 (SEQ ID NO:294), having experiment number MSE2351. Control vector pKR1256 (SEQ ID NO:98; Example 16), comprising *Yarrowia* DGAT2, was also transformed alone in a similar way for a control and has experiment number MSE2349.

Example 32

Expression of DGAT1s from *Yarrowia lipolytica* and *Lipomyces starkeyi* in Soybean Somatic Embryos The present example describes construction of pKR1375, comprising Lipomyces diacylglyceride acyltransferase 1 (LS DGAT1) and expression in somatic embryos. Control vector pKR1323 (SEQ ID NO:289) described in Example 30, comprising YL DGAT1 cod2, was also expressed for comparison.

Construction of pKR1375, Comprising LS DGAT1

Because the LS_DGAT1 genomic sequence (SEQ ID NO:189; Example 22) appeared to contain numerous introns when compared to other DGATs by BlastX analysis, the LS_DGAT1 coding sequence was cloned by PCR from cDNA. cDNA synthesis is described in Example 22.

Based on the genomic sequence of LS_DGAT1 (SEQ ID NO:189). LS_DGAT1 was amplified from cDNA with oligonucleotide primers oLsDGAT1-5-1 (SEQ ID NO:295) and oLsDGAT1-3 (SEQ ID NO:296), using the Phusion™ High-Fidelity DNA Polymerase (Cat. No. F553S, Finnzymes Oy, Finland) following the manufacturer's protocol. Isolation of RNA and synthesis of cDNA from *Lipomyces starkeyi* is described in Example 22. The resulting DNA fragment was cloned into the pCR-Blunt® cloning vector using the Zero Blunt® PCR Cloning Kit (Invitrogen Corporation), following the manufacturer's protocol, to produce pHD38 (SEQ ID NO:297). Nucleotide and corresponding amino acid sequences of the *Lipomyces starkeyi* DGAT1 transcript are set forth in SEQ ID NO:298 and SEQ ID NO:299, respectively. A BLASTP search of the annotated fungal protein database at NCBI was conducted. The deduced amino acid sequence of the *Lipomyces starkeyi* DGAT1 transcript shares 52.4% sequence identity to a hypothetical protein product from *Coccidioides immitis* with GENBANK accession number XP_001247089 which represents the protein with the closest similarity in this database. The protein has been annotated as member of the MBOAT (membrane bound O-acyl transferase) family of membrane proteins that contains a variety of acyltransferase enzymes.

The NotI fragment of pHD38 (SEQ ID NO:297), containing LS_DGAT1, was cloned into the NotI site of pKR72 (SEQ ID NO:26; Example 4) to produce pKR1375 (SEQ ID NO:300).

Expression of YL DGAT1 cod2 and LS DGAT1 in Soy Somatic Embryos

Soybean embryogenic suspension culture (cv. Jack) was transformed with pKR1375 (SEQ ID NO:300), having experiment number MSE2352. Control vector pKR1323 (SEQ ID NO:289), comprising YL DGAT1cod2, was also transformed in a similar way and has experiment number MSE2350.

Example 33

DGAT1 Gene Sequences from *Mortierella alpina* and *Lipomyces starkeyi* that are Optimized for Expression in Soy Beans Nucleotide sequences encoding MA DGAT1 (SEQ ID NO:278) and LS DGAT1 (SEQ ID NO:298) were re-designed for optimized expression in soybean seed using methods similar to those described in Wu, G et al. *Nucleic Acids*

Research (2007), 35: D76-D79; Villalobos, A. et al. BMC Bioinformatics (2006), 7 No pp. given; Wu, G. et al. *Protein Expression and Purification* (2006), 47: 441-445; Richardson, S. M. et al. *Genome Research* (2006), 16: 550-556; Jayaraj, S. et al. *Nucleic Acids Research* (2005) 33: 3011-3016. DNA molecules were synthesized by Codon Devices (MA, USA). Expression-optimized DNA sequences of MA DGAT1 and LS DGAT1 are set forth in SEQ ID NO:301 and SEQ ID NO:302, respectively. The amino acid sequences of proteins encoded by these DNA sequences at set forth as SEQ ID NO:279 and SEQ ID NO:299.

Example 34

Expression Optimized DGAT2 Gene Sequences Encoding DGAT2 Protein Variants

Nucleotide sequences encoding DGAT2 proteins from *Torulaspora delbrueckii, Pichia anomala, Debaryomyces hansenii, Candida zeylanoides, Lipomyces starkeyi, Mucor circinelloides, Phaffia rhodozyma, Rhodotorula glutinis* and *Mortierella alpina* described herein (see previous Examples 18-32) were re-designed for optimized expression in soybean seed using methods similar to those described in Wu, G et al. *Nucleic Acids Research* (2007), 35: D76-D79; Villalobos, A. et al. *BMC Bioinformatics* (2006), 7 No pp. given; Wu, G. et al. *Protein Expression and Purification* (2006), 47: 441-445; Richardson, S. M. et al. *Genome Research* (2006), 16: 550-556; Jayaraj, S. et al. *Nucleic Acids Research* (2005) 33: 3011-3016. DNA molecules were synthesized by Codon Devices (MA, USA). Expression-optimized DNA sequences and DGAT2 proteins encoded by said DNA sequences and related SEQ ID NOs are shown in Table 58. All DGAT2 variants contain the motif FxxPxFR that was altered from FxxPxYR present in the native DGAT2 proteins.

TABLE 58

| Gene name | ORF (SEQ ID NO:) | AA (SEQ ID NO:) |
|---|---|---|
| TD_DGAT2Acod | 303 | 304 |
| TD_DGAT2Bcod | 305 | 306 |
| PA_DGAT2cod | 307 | 308 |
| DH_DGAT2cod | 309 | 310 |
| CZ_DGAT2cod | 311 | 312 |
| LS_DGAT2cod | 313 | 314 |
| MC_DGAT2cod | 315 | 316 |
| PR_DGAT2cod | 317 | 318 |
| RG_DGAT2cod | 319 | 320 |
| MA_DGAT2cod | 321 | 322 |

Example 35

Co-Expression of YL DGAT1 with a FAD2/TE2 Down Regulation Construct in Soybean Somatic Embryos The present example describes construction of soybean expression vectors pKR1274, comprising *Yarrowia* DGAT1 (YL DGAT1) and either pKR1267 or pKR1269, comprising a soybean fatty acid desaturase 2 (GM FAD2)/thioesterase 2 (GM TE2) down-regulation construct. While the GM FAD2-TE2 down-regulation region of pKR1267 and pKR1269 are identical in each construct and both are driven by the KTi3 promoter, pKR1267 contains only the KTi3 terminator and pKR1269 contains both the KTi3 and soy albumin terminators.

Construction of pKR1274 Comprising YL DGAT1

A starting plasmid pKR85 (SEQ ID NO:27), which was previously described in Example 4 contains the hygromycin B phosphotransferase gene (HPT) (Gritz, L. and Davies, J., *Gene* 25:179-188 (1983)), flanked by the T7 promoter and transcription terminator (T7prom/hpt/T7term cassette), and a bacterial origin of replication (ori) for selection and replication in bacteria (e.g., *E. coli*). In addition, pKR72 also contains the hygromycin B phosphotransferase gene, flanked by the 35S promoter (Odell et al., *Nature* 313:810-812 (1985)) and NOS 3' transcription terminator (Depicker et al., *J. Mol. Appl. Genet.* 1:561-570 (1982)) (35S/hpt/NOS3' cassette) for selection in plants such as soybean. Plasmid pKR85 (SEQ ID NO:27) also contains a NotI restriction site, flanked by the promoter for the α' subunit of β-conglycinin (Beachy et al., *EMBO J.* 4:3047-3053 (1985)) and the 3' transcription termination region of the phaseolin gene (Doyle et al., *J. Biol. Chem.* 261:9228-9238 (1986)), called Bcon/NotI/Phas3' cassette.

The Bcon/NotI/Phas3' cassette was removed from pKR85 (SEQ ID NO:27) by digestion with HindIII and the resulting fragment was re-ligated to produce pKR278 (SEQ ID NO:323).

The BsiWI fragment of pKR1235 (SEQ ID NO:74, Example 14), containing the YL DGAT1, was cloned into the BsiWI site of pKR278 (SEQ ID NO:323), which was previously described in US Pat. Pub. US20080095915 (the contents of which are incorporated by reference), to produce pKR1274 (SEQ ID NO:324).

Construction of pKR1267 Comprising GM FAD2-TE2 Down-Regulation Cassette

The 5' end of GM TE2 (SEQ ID NO:325) was amplified from pTC4 (SEQ ID NO:326), which was previously described in WO1996006936A1 (the contents of which are incorporated by reference), with oligonucleotide primers GmTE2_5-1 (SEQ ID NO:327) and GmTE2_3-1 (SEQ ID NO:328), using the Phusion™ High-Fidelity DNA Polymerase (Cat. No. F553S, Finnzymes Oy, Finland) following the manufacturer's protocol. The 3' end of GM TE2 (SEQ ID NO:325) was amplified from pTC4 (SEQ ID NO:326) with oligonucleotide primers GmTE2_5-2 (SEQ ID NO:329) and GmTE2_3-2 (SEQ ID NO:330), using the Phusion™ High-Fidelity DNA Polymerase (Cat. No. F553S, Finnzymes Oy, Finland) following the manufacturer's protocol. The resulting two PCR products were combined and amplified with GmTE2_5-1 (SEQ ID NO:327) and GmTE2_3-2 (SEQ ID NO:330) using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1258 (SEQ ID NO:331).

The 5' end of GM FAD2 (SEQ ID NO:332) was amplified from pBS43 (SEQ ID NO:333), which was previously described in WO1997047731A2 (the contents of which are incorporated by reference), with oligonucleotide primers GmFAD2-1_5-1 (SEQ ID NO:334) and GmFAD2-1_3-1 (SEQ ID NO:335), using the Phusion™ High-Fidelity DNA Polymerase (Cat. No. F553S, Finnzymes Oy, Finland) following the manufacturer's protocol. The 3' end of GM FAD2-1 (SEQ ID NO:332) was amplified from pBS43 (SEQ ID NO:333) with oligonucleotide primers GmFAD2-1_5-2 (SEQ ID NO:336) and GmFAD2-1_3-2 (SEQ ID NO:337), using the Phusion™ High-Fidelity DNA Polymerase (Cat. No. F553S, Finnzymes Oy, Finland) following the manufacturer's protocol. The resulting two PCR products were combined and amplified with GmFAD2-1_5-1 (SEQ ID NO:334)

and GmFAD2-1_3-2 (SEQ ID NO:337) using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce PCRblunt-Fad2-1 (SEQ ID NO:338).

The MluI fragment of pKR1258 (SEQ ID NO:331), containing GM TE2, was cloned into the MluI fragment of PCR-blunt-Fad2-1 (SEQ ID NO:338), containing GM FAD2-1, to produce pKR1259 (SEQ ID NO:339).

The EcoRI fragment of pKR1259 (SEQ ID NO:339) which comprises the 5' end of the GM FAD2/TE2 fragment, was cloned into the MfeI site of pKR1259 (SEQ ID NO:339) to produce pKR1261 (SEQ ID NO:340). This DNA construct contains a GM FAD2-TE2-TE2loop-TE2-FAD2 haripin structure flanked by NotI sites.

The NotI fragment of pKR1261 (SEQ ID NO:340), containing GM FAD2-TE2-TE2loop-TE2-FAD2, was cloned into the NotI site of pKR123R (SEQ ID NO:341), which was previously described in WO2004071467A2 (the contents of which are incorporated by reference), to produce pKR1266 (SEQ ID NO:342).

The BsiWI/PstI fragment of pKR1266 (SEQ ID NO:342), containing the GM FAD2-TE2-TE2loop-TE2-FAD2 was cloned into the BsiWI/SbfI fragment of pKR278 (SEQ ID NO:323) to produce pKR1267 (SEQ ID NO:343).

Construction of pKR1267 Comprising GM FAD2-TE2 Down-Regulation Cassette

The NotI fragment of pKR1261 (SEQ ID NO:340), containing GM FAD2-TE2-TE2loop-TE2-FAD2, was cloned into the NotI site of pKR457 (SEQ ID NO:344), which was previously described in PCT Publication No. WO 2005/047479 (the contents of which are hereby incorporated by reference), to produce pKR1264 (SEQ ID NO:345).

The PstI fragment of pKR1264 (SEQ ID NO:345), containing the GM FAD2-TE2-TE2loop-TE2-FAD2 was cloned into the SbfI fragment of pKR277 (SEQ ID NO:346), which was previously described in PCT Publication No. WO 2004/071467 to produce pKR1269 (SEQ ID NO:347).

Co-Expression of GM FAD2-TE2-TE2loop-TE2-FAD2 Down-Requlation Constructs Either Alone or with YL DGAT2

Soybean embryogenic suspension culture (cv. Jack) was transformed with the pKR1267 (SEQ ID NO:343) alone and having experiment number MSE2213 or with the BsiWI fragment of pKR1269 (SEQ ID NO:347) and pKR1274 (SEQ ID NO:324) and having experiment number MSE2210. Events were selected and somatic embryos matured in SHaM as described in Example 5. Oil concentrations and fatty acid profiles were determined as described in Example 4 for MSE2213 and MSE2210 and results for each experiment are shown in Table 59 and Table 60, respectively.

TABLE 59

Oil concentrations and fatty acid profiles for events from MSE2213 MSE2213 (GM FAD2-TE2-TE2loop-TE2-FAD2)

| Event | 16:0 | 18:0 | 18:1 | 18:2 | 18:3 | % Oil |
|---|---|---|---|---|---|---|
| 2213-16 | 5.8 | 2.6 | 72.7 | 10.5 | 8.5 | 16.8 |
| 2213-26 | 12.0 | 5.7 | 24.8 | 47.2 | 10.4 | 16.5 |
| 2213-30 | 11.7 | 5.3 | 18.5 | 53.1 | 11.4 | 15.4 |
| 2213-23 | 9.0 | 3.2 | 52.2 | 24.7 | 11.0 | 15.3 |
| 2213-29 | 13.1 | 3.7 | 13.3 | 57.1 | 12.8 | 15.0 |
| 2213-7 | 6.4 | 3.1 | 66.3 | 15.6 | 8.6 | 14.9 |
| 2213-31 | 11.7 | 3.0 | 26.9 | 46.5 | 11.9 | 14.5 |

TABLE 59-continued

Oil concentrations and fatty acid profiles for events from MSE2213 MSE2213 (GM FAD2-TE2-TE2loop-TE2-FAD2)

| Event | 16:0 | 18:0 | 18:1 | 18:2 | 18:3 | % Oil |
|---|---|---|---|---|---|---|
| 2213-13 | 6.7 | 3.3 | 64.5 | 16.6 | 8.9 | 14.4 |
| 2213-5 | 3.5 | 3.0 | 78.0 | 7.5 | 8.1 | 13.8 |
| 2213-9 | 7.6 | 3.4 | 57.6 | 20.3 | 11.0 | 13.2 |
| 2213-20 | 7.8 | 4.1 | 56.7 | 20.8 | 10.6 | 13.1 |
| 2213-4 | 4.1 | 2.7 | 72.1 | 11.1 | 10.0 | 12.7 |
| 2213-17 | 7.7 | 5.2 | 57.0 | 19.7 | 10.4 | 12.5 |
| 2213-3 | 7.4 | 3.6 | 64.4 | 14.4 | 10.2 | 12.5 |
| 2213-24 | 12.9 | 7.3 | 29.4 | 39.0 | 11.4 | 12.1 |
| 2213-1 | 13.8 | 7.1 | 22.1 | 44.6 | 12.4 | 11.9 |
| 2213-6 | 6.7 | 2.2 | 57.2 | 22.2 | 11.7 | 11.8 |
| 2213-11 | 9.2 | 5.2 | 58.2 | 16.4 | 11.0 | 10.9 |
| 2213-2 | 7.8 | 4.3 | 45.3 | 31.0 | 11.7 | 10.6 |
| 2213-14 | 7.3 | 4.6 | 63.0 | 15.0 | 10.2 | 10.5 |
| 2213-27 | 8.5 | 6.0 | 48.9 | 25.0 | 11.6 | 10.1 |
| 2213-19 | 8.0 | 4.0 | 53.7 | 21.4 | 12.8 | 9.9 |
| 2213-21 | 11.1 | 5.6 | 28.3 | 40.6 | 14.4 | 9.8 |
| 2213-18 | 7.4 | 4.1 | 57.2 | 17.7 | 13.5 | 9.4 |
| 2213-12 | 6.4 | 4.3 | 63.2 | 15.5 | 10.6 | 9.4 |
| 2213-10 | 13.8 | 7.0 | 24.0 | 42.1 | 13.2 | 9.4 |
| 2213-28 | 8.8 | 4.1 | 54.1 | 19.1 | 13.8 | 9.1 |
| 2213-25 | 6.9 | 3.5 | 53.9 | 21.9 | 13.8 | 9.0 |
| 2213-15 | 5.2 | 3.4 | 61.7 | 17.6 | 12.1 | 8.0 |
| 2213-8 | 14.4 | 6.6 | 20.0 | 42.9 | 16.1 | 7.6 |
| 2213-22 | 14.3 | 6.3 | 21.3 | 41.9 | 16.2 | 7.2 |
| Avg. | 8.9 | 4.4 | 47.9 | 27.1 | 11.6 | 11.9 |

TABLE 60

Oil concentrations and fatty acid profiles for events from MSE2210 MSE2210 (YL DGAT1 & GM FAD2-TE2-TE2loop-TE2-FAD2)

| Event | 16:0 | 18:0 | 18:1 | 18:2 | 18:3 | % Oil |
|---|---|---|---|---|---|---|
| 2210-2 | 3.8 | 2.7 | 74.7 | 13.1 | 5.8 | 22.1 |
| 2210-23 | 10.3 | 6.8 | 32.0 | 44.4 | 6.5 | 20.0 |
| 2210-29 | 7.5 | 5.5 | 63.9 | 17.1 | 6.0 | 20.0 |
| 2210-19 | 3.9 | 3.5 | 79.1 | 8.1 | 5.4 | 19.7 |
| 2210-10 | 7.3 | 3.8 | 66.6 | 15.6 | 6.7 | 19.6 |
| 2210-12 | 5.7 | 3.6 | 67.6 | 17.6 | 5.6 | 19.6 |
| 2210-14 | 4.5 | 2.4 | 67.9 | 17.8 | 7.4 | 19.3 |
| 2210-25 | 5.1 | 3.5 | 71.8 | 13.1 | 6.4 | 18.4 |
| 2210-5 | 9.0 | 4.1 | 43.1 | 35.9 | 7.9 | 17.8 |
| 2210-24 | 13.7 | 4.3 | 20.5 | 52.5 | 9.1 | 17.5 |
| 2210-13 | 10.2 | 5.5 | 36.8 | 40.4 | 7.0 | 17.4 |
| 2210-11 | 10.9 | 7.8 | 30.6 | 43.2 | 7.5 | 16.6 |
| 2210-1 | 4.1 | 3.0 | 75.6 | 9.6 | 7.7 | 15.9 |
| 2210-6 | 2.7 | 1.7 | 83.9 | 5.3 | 6.4 | 15.5 |
| 2210-16 | 8.4 | 3.7 | 48.5 | 31.3 | 8.1 | 15.3 |
| 2210-26 | 7.1 | 4.9 | 55.2 | 24.7 | 8.1 | 14.4 |
| 2210-7 | 4.3 | 3.2 | 62.9 | 20.8 | 8.7 | 14.3 |
| 2210-20 | 6.8 | 4.3 | 65.2 | 15.7 | 7.9 | 13.8 |
| 2210-27 | 10.9 | 7.4 | 42.4 | 30.0 | 9.3 | 13.8 |
| 2210-30 | 5.0 | 2.4 | 65.1 | 17.1 | 10.4 | 13.7 |
| 2210-3 | 7.1 | 4.8 | 52.9 | 27.4 | 7.9 | 13.6 |
| 2210-4 | 6.0 | 3.7 | 66.0 | 15.9 | 8.5 | 13.3 |
| 2210-22 | 3.2 | 3.3 | 77.7 | 8.1 | 7.8 | 13.2 |
| 2210-8 | 9.1 | 4.9 | 49.7 | 27.3 | 9.0 | 13.1 |
| 2210-21 | 6.0 | 3.5 | 67.8 | 14.9 | 7.8 | 12.8 |
| 2210-18 | 12.7 | 5.2 | 20.2 | 49.7 | 12.1 | 12.5 |
| 2210-31 | 4.4 | 2.9 | 73.1 | 10.1 | 9.5 | 11.7 |
| 2210-9 | 4.0 | 3.1 | 74.1 | 9.3 | 9.6 | 11.2 |
| 2210-15 | 3.5 | 2.4 | 72.5 | 11.0 | 10.6 | 11.1 |
| 2210-28 | 14.1 | 5.7 | 20.2 | 45.5 | 14.5 | 10.1 |
| 2217-29 | 12.0 | 7.5 | 28.0 | 38.8 | 13.8 | 8.7 |
| Avg. | 7.2 | 4.2 | 56.6 | 23.6 | 8.4 | 15.4 |

Comparison of results in Tables 59 and 60 demonstrates that combination of YL DGAT1 expression with down-regulation of GM FAD2-1 and GM TE2 changes the fatty acid profile to an extend that exceeds the change that observed when only FAD2-1 and TE2 genes are suppressed.

Example 36

Cloning the cDNA for DGAT2 from *Cryptococcus curvatus*

Because the CC DGAT2 genomic sequence (SEQ ID NO:226; Example 25) appeared to contain numerous introns when compared to other DGATs by BlastX analysis, the CC DGAT2 coding sequence was cloned by PCR from cDNA.

RNA was isolated from *Cryptococcus curvatus* and cDNA was synthesized as described in Example 25. Analysis of the CC DGAT2 genomic sequence (SEQ ID NO:226; Example 25) suggested a potential ORF initiation site and a 5' oligo was constructed to the ORF initiation site. CC DGAT2 was amplified from the cDNA (2 μL) with oligonucleotide primers CC ORF FWD (SEQ ID NO:348) and CC ORF REV (SEQ ID NO:349), using GoTaq polymerase (Promega, USA) following the manufacturer's protocol. The resulting DNA fragment was cloned into PGEM T-easy (Promega) using manufacturer instructions and sequenced. The CC DGAT2 cDNA nucleotide and corresponding amino acid sequences are set forth in SEQ ID NO:350 and SEQ ID NO:351, respectively. A BLASTP search of the annotated fungal protein database at NCBI was conducted. Based on a CLUSTALW alignment, the deduced amino acid sequence of the CC DGAT2 cDNA shares 61% sequence identity to a DGAT2 protein product from *Cryptococcus neoformans* with GENBANK accession number XP_571236 which represents the protein with the closest similarity in this database.

Example 37

Functional Analysis of DGAT2s from *Yarrowia lipolyitica* and *Lipomyces starkevi* and DGAT1 s from *Yarrowia lipolytica* and *Mortierella alapin* in Soybean Somatic Embryos in Soybean Somatic Embryos The present example describes the expression of pKR1337 (SEQ ID NO:273, Example 29), comprising *Lipomyces starkeyi* diacylglyceride acyltransferase 2 (LS_DGAT2), pKR1256 (SEQ ID NO:98; Example 16), comprising *Yarrowia* DGAT2 (YL_DGAT2), pKR1334 (SEQ ID NO:280, Example 30), comprising *Mortierella* diacylglyceride acyltransferase 1 (Ma_DGAT1) and pKR1323 (SEQ ID NO:289, Example 30), comprising *Yarrowia* DGAT1 codon optimized for expression in soy (YL_DGAT1 cod2), in soy somatic embryos (Experiment numbers MSE2333, MSE2334, MSE2332 and MSE2331, respectively).

Events from each experiment were selected, somatic embryos were matured in SHaM and oil concentrations and fatty acid profiles were determined as described in Example 5. Results for MSE2331, MSE2332, MSE2333 and 2334 are shown in Table 61, Table 62, Table 63 and Table 64, respectively.

TABLE 61

Oil concentrations and fatty acid profiles for events from MSE2331 MSE2331 (YL DGAT1cod2)

| Event | 16:0 | 18:0 | 18:1 | 18:2 | 18:3 | % Oil |
|---|---|---|---|---|---|---|
| 2331-18 | 11.2 | 5.8 | 36.5 | 41.0 | 5.5 | 19.5 |
| 2331-29 | 11.3 | 5.6 | 41.7 | 36.8 | 4.6 | 18.0 |
| 2331-27 | 11.1 | 5.5 | 37.1 | 40.6 | 5.7 | 17.5 |
| 2331-14 | 11.6 | 4.6 | 32.9 | 43.7 | 7.2 | 16.3 |
| 2331-5 | 13.3 | 4.1 | 28.4 | 46.6 | 7.6 | 16.1 |
| 2331-13 | 12.5 | 5.7 | 34.9 | 39.9 | 7.0 | 15.6 |
| 2331-21 | 12.8 | 3.8 | 27.4 | 47.6 | 8.4 | 15.4 |
| 2331-16 | 11.7 | 4.9 | 34.9 | 41.2 | 7.2 | 14.4 |
| 2331-2 | 11.6 | 5.2 | 32.4 | 43.0 | 7.7 | 14.4 |
| 2331-17 | 11.0 | 5.4 | 35.4 | 41.0 | 7.3 | 14.3 |
| 2331-11 | 12.4 | 4.2 | 28.6 | 45.1 | 9.7 | 13.8 |
| 2331-24 | 11.8 | 7.4 | 37.0 | 36.9 | 6.9 | 12.4 |
| 2331-19 | 13.0 | 6.1 | 32.9 | 39.7 | 8.2 | 12.2 |
| 2331-9 | 13.6 | 5.3 | 29.3 | 42.8 | 9.0 | 12.2 |
| 2331-20 | 14.8 | 4.6 | 20.9 | 48.5 | 11.3 | 11.8 |
| 2331-28 | 14.2 | 5.2 | 25.5 | 45.7 | 9.3 | 11.7 |
| 2331-8 | 14.6 | 4.0 | 24.3 | 46.2 | 10.9 | 11.6 |
| 2331-15 | 15.6 | 3.8 | 20.3 | 48.3 | 12.0 | 11.5 |
| 2331-7 | 14.4 | 3.9 | 20.6 | 50.3 | 10.9 | 11.4 |
| 2331-4 | 14.0 | 4.2 | 25.1 | 47.4 | 9.4 | 11.2 |
| 2331-31 | 12.3 | 6.2 | 31.3 | 40.9 | 9.3 | 10.4 |
| 2331-26 | 13.4 | 4.0 | 16.4 | 54.3 | 11.8 | 10.3 |
| 2331-30 | 13.3 | 8.0 | 34.7 | 36.0 | 8.1 | 10.1 |
| 2331-12 | 13.8 | 6.4 | 29.1 | 40.5 | 10.1 | 9.7 |
| 2331-6 | 13.4 | 6.9 | 32.7 | 38.0 | 9.0 | 9.5 |
| 2331-1 | 14.3 | 5.6 | 31.3 | 36.9 | 11.8 | 8.2 |
| 2331-23 | 15.8 | 4.4 | 19.2 | 46.6 | 14.0 | 8.1 |
| 2331-10 | 16.1 | 4.3 | 20.9 | 44.2 | 14.5 | 7.8 |
| 2331-22 | 15.2 | 6.7 | 22.0 | 43.1 | 13.1 | 7.6 |
| 2331-25 | 16.9 | 5.7 | 22.1 | 40.1 | 15.2 | 5.5 |
| 2331-3 | 15.3 | 5.5 | 24.6 | 39.0 | 15.6 | 4.6 |
| Avg. | 13.4 | 5.3 | 28.7 | 43.0 | 9.6 | 12.0 |

TABLE 62

Oil concentrations and fatty acid profiles for events from MSE2332 MSE2332 (MA DGAT1)

| Event | 16:0 | 18:0 | 18:1 | 18:2 | 18:3 | % Oil |
|---|---|---|---|---|---|---|
| 2332-31 | 16.0 | 6.7 | 22.9 | 38.9 | 15.6 | 18.9 |
| 2332-15 | 11.6 | 5.8 | 38.4 | 37.5 | 6.6 | 15.1 |
| 2332-29 | 16.5 | 5.1 | 21.3 | 41.2 | 15.9 | 13.9 |
| 2332-9 | 12.4 | 4.5 | 33.2 | 41.4 | 8.6 | 13.8 |
| 2332-14 | 12.1 | 5.5 | 36.9 | 38.4 | 7.2 | 13.6 |
| 2332-22 | 12.3 | 6.5 | 36.0 | 37.3 | 7.9 | 13.2 |
| 2332-26 | 12.0 | 5.3 | 36.8 | 38.1 | 7.7 | 13.2 |
| 2332-20 | 16.9 | 5.2 | 17.7 | 43.1 | 17.1 | 12.7 |
| 2332-25 | 12.7 | 5.7 | 35.8 | 38.3 | 7.6 | 12.5 |
| 2332-21 | 13.0 | 6.8 | 34.4 | 37.8 | 8.0 | 12.0 |
| 2332-6 | 13.2 | 5.6 | 34.1 | 38.0 | 9.1 | 11.5 |
| 2332-24 | 13.0 | 6.5 | 35.5 | 37.5 | 7.5 | 11.3 |
| 2332-23 | 13.7 | 6.4 | 33.7 | 37.3 | 8.9 | 11.1 |
| 2332-2 | 13.0 | 5.5 | 33.3 | 38.5 | 9.7 | 10.5 |
| 2332-1 | 13.5 | 5.6 | 31.5 | 39.4 | 10.0 | 10.0 |
| 2332-19 | 14.0 | 6.2 | 31.8 | 38.1 | 9.9 | 9.8 |
| 2332-11 | 14.4 | 5.6 | 28.8 | 40.6 | 10.7 | 9.4 |
| 2332-7 | 15.1 | 5.0 | 26.6 | 42.6 | 10.7 | 9.1 |
| 2332-13 | 15.6 | 4.9 | 23.2 | 43.5 | 12.8 | 8.8 |
| 2332-18 | 15.3 | 4.5 | 21.4 | 45.4 | 13.5 | 8.1 |
| 2332-8 | 16.1 | 4.3 | 19.7 | 46.1 | 13.8 | 7.9 |
| 2332-16 | 16.7 | 4.2 | 20.8 | 43.5 | 14.8 | 7.1 |
| 2332-12 | 15.6 | 6.5 | 23.7 | 39.8 | 14.4 | 6.8 |
| 2332-4 | 16.8 | 5.2 | 20.5 | 41.3 | 16.2 | 6.1 |
| 2332-17 | 16.4 | 5.5 | 23.0 | 40.1 | 15.0 | 6.0 |
| 2332-28 | 17.1 | 5.4 | 23.0 | 37.1 | 17.4 | 5.5 |
| 2332-10 | 16.9 | 4.6 | 18.3 | 41.7 | 18.5 | 5.3 |
| 2332-3 | 16.2 | 5.5 | 20.6 | 41.9 | 15.8 | 5.3 |
| 2332-5 | 17.1 | 5.1 | 19.6 | 39.7 | 18.5 | 4.6 |
| 2332-30 | 11.9 | 3.7 | 34.4 | 41.6 | 8.3 | 4.5 |
| 2332-27 | 15.9 | 5.8 | 19.7 | 39.9 | 18.7 | 4.1 |
| Avg. | 14.6 | 5.4 | 27.6 | 40.2 | 12.1 | 9.7 |

TABLE 63

Oil concentrations and fatty acid profiles for events from MSE2333 MSE2333 (LS DGAT2)

| Event | 16:0 | 18:0 | 18:1 | 18:2 | 18:3 | % Oil |
|---|---|---|---|---|---|---|
| 2333-2 | 15.5 | 6.8 | 28.2 | 38.0 | 11.5 | 12.2 |
| 2333-23 | 13.8 | 5.2 | 28.7 | 43.1 | 9.2 | 11.6 |
| 2333-27 | 13.4 | 6.0 | 35.3 | 37.2 | 8.1 | 10.5 |
| 2333-8 | 16.2 | 5.1 | 21.1 | 40.8 | 16.7 | 10.3 |
| 2333-21 | 14.4 | 6.1 | 30.9 | 39.5 | 9.1 | 9.3 |
| 2333-20 | 14.1 | 7.0 | 32.3 | 37.0 | 9.7 | 9.3 |
| 2333-1 | 10.3 | 4.3 | 44.0 | 36.3 | 5.1 | 8.6 |
| 2333-29 | 15.5 | 6.0 | 28.0 | 39.2 | 11.3 | 8.4 |
| 2333-14 | 14.2 | 5.3 | 27.8 | 40.7 | 12.0 | 8.2 |
| 2333-17 | 14.6 | 6.5 | 32.4 | 36.1 | 10.4 | 7.6 |
| 2333-28 | 15.0 | 6.8 | 30.1 | 37.0 | 11.2 | 7.6 |
| 2333-26 | 16.8 | 4.8 | 21.8 | 43.3 | 13.4 | 7.3 |
| 2333-18 | 15.3 | 5.4 | 29.7 | 37.5 | 12.1 | 6.8 |
| 2333-16 | 15.4 | 5.5 | 25.2 | 39.9 | 13.9 | 6.7 |
| 2333-11 | 16.4 | 7.2 | 26.0 | 37.3 | 13.1 | 6.5 |
| 2333-24 | 13.9 | 4.9 | 24.4 | 41.9 | 14.8 | 6.3 |
| 2333-15 | 15.4 | 5.4 | 28.2 | 37.7 | 13.3 | 6.2 |
| 2333-4 | 12.4 | 5.7 | 33.8 | 39.8 | 8.3 | 5.6 |
| 2333-5 | 17.0 | 5.5 | 19.0 | 41.4 | 17.2 | 5.4 |
| 2333-10 | 16.0 | 6.0 | 21.7 | 40.9 | 15.4 | 5.4 |
| 2333-12 | 15.6 | 5.5 | 25.7 | 36.7 | 16.5 | 5.4 |
| 2333-31 | 15.4 | 5.7 | 26.7 | 37.9 | 14.2 | 5.1 |
| 2333-7 | 16.4 | 5.4 | 20.8 | 41.2 | 16.2 | 5.1 |
| 2333-19 | 16.2 | 6.7 | 26.6 | 36.6 | 14.0 | 4.9 |
| 2333-30 | 15.9 | 5.5 | 25.9 | 37.6 | 15.1 | 4.8 |
| 2333-6 | 16.9 | 5.6 | 22.6 | 38.8 | 16.1 | 4.6 |
| 2333-25 | 15.4 | 5.6 | 21.7 | 39.4 | 17.9 | 4.4 |
| 2333-3 | 13.4 | 5.1 | 31.4 | 40.9 | 9.1 | 4.4 |
| 2333-9 | 13.9 | 6.1 | 31.2 | 41.2 | 7.7 | 3.9 |
| 2333-13 | 17.2 | 4.5 | 15.8 | 41.5 | 21.0 | 3.8 |
| 2333-22 | 16.6 | 5.6 | 21.4 | 37.3 | 19.1 | 2.9 |
| Avg. | 15.1 | 5.7 | 27.0 | 39.2 | 13.0 | 6.7 |

TABLE 64

Oil concentrations and fatty acid profiles for events from MSE2334 MSE2334 (YL DGAT2)

| Event | 16:0 | 18:0 | 18:1 | 18:2 | 18:3 | % Oil |
|---|---|---|---|---|---|---|
| 2334-25 | 11.8 | 6.0 | 36.3 | 38.4 | 7.4 | 12.9 |
| 2334-12 | 12.5 | 6.9 | 37.9 | 36.2 | 6.6 | 12.5 |
| 2334-5 | 13.7 | 4.9 | 31.7 | 41.7 | 7.9 | 12.1 |
| 2334-3 | 12.4 | 5.3 | 38.6 | 36.4 | 7.3 | 11.1 |
| 2334-19 | 12.5 | 6.0 | 33.0 | 38.2 | 10.3 | 10.8 |
| 2334-4 | 13.0 | 5.1 | 33.7 | 39.2 | 9.0 | 10.7 |
| 2334-24 | 13.1 | 5.8 | 33.4 | 37.3 | 10.4 | 10.1 |
| 2334-1 | 15.0 | 5.0 | 29.4 | 40.5 | 10.2 | 9.5 |
| 2334-18 | 13.8 | 5.1 | 30.1 | 40.3 | 10.6 | 9.3 |
| 2334-15 | 14.6 | 6.0 | 31.3 | 37.6 | 10.5 | 8.8 |
| 2334-17 | 13.7 | 5.4 | 32.5 | 37.0 | 11.4 | 8.4 |
| 2334-30 | 15.3 | 5.6 | 29.4 | 37.4 | 12.2 | 7.9 |
| 2334-16 | 15.2 | 6.5 | 29.6 | 37.0 | 11.8 | 7.3 |
| 2334-21 | 15.4 | 7.5 | 28.8 | 36.5 | 11.8 | 7.2 |
| 2334-11 | 14.5 | 6.8 | 33.7 | 34.0 | 11.0 | 6.7 |
| 2334-28 | 14.9 | 4.5 | 27.2 | 39.1 | 14.3 | 6.5 |
| 2334-27 | 15.8 | 5.8 | 28.4 | 37.1 | 12.9 | 6.3 |
| 2334-14 | 16.1 | 7.7 | 27.6 | 35.4 | 13.1 | 6.3 |
| 2334-26 | 15.9 | 6.4 | 24.1 | 40.2 | 13.4 | 6.2 |
| 2334-9 | 16.6 | 4.1 | 18.3 | 42.3 | 18.8 | 6.1 |
| 2334-20 | 17.3 | 4.5 | 19.2 | 41.6 | 17.4 | 5.6 |
| 2334-8 | 15.2 | 5.0 | 27.8 | 36.4 | 15.6 | 5.6 |
| 2334-22 | 16.3 | 6.1 | 26.4 | 36.5 | 14.6 | 5.5 |
| 2334-2 | 15.8 | 4.6 | 22.3 | 40.4 | 16.9 | 4.9 |
| 2334-10 | 17.0 | 5.0 | 22.3 | 38.8 | 16.9 | 4.9 |
| 2334-29 | 18.7 | 3.6 | 9.5 | 47.9 | 20.3 | 4.8 |
| 2334-7 | 16.5 | 5.6 | 23.0 | 36.9 | 17.9 | 4.7 |
| 2334-23 | 16.6 | 4.8 | 17.3 | 41.5 | 19.9 | 4.6 |
| 2334-6 | 19.3 | 6.1 | 23.5 | 36.4 | 14.6 | 4.0 |
| 2334-13 | 18.5 | 5.6 | 20.5 | 37.1 | 18.4 | 3.3 |
| Avg. | 15.2 | 5.6 | 27.6 | 38.5 | 13.1 | 7.5 |

LS_DGAT2 increases oil and oleic acid concentration in somatic embryos to amounts similar to YL DGAT2. YL DGAT1 (cod2) and MA DGAT1 increase oleic similarly to YL DGAT2 and have higer oil increases with YL DGAT1 (cod2) having the highest oil.

Example 38

Functional Analysis of DGAT2s from *Yarrowia lipolyitica* and *Phaffia rhodozyma* and DGAT1s from *Yarrowia lipolytica* and *Lipomyces starkeyi* in Soybean Somatic Embryos The present example describes the expression of pKR1372 (SEQ ID NO:294, Example 31), comprising *Phaffia rhodozyma* diacylglyceride acyltransferase 2 (PR_DGAT2), pKR1256 (SEQ ID NO:98; Example 16), comprising *Yarrowia* DGAT2 (YL_DGAT2), pKR1375 (SEQ ID NO:300, Example 32), comprising Lipomyces diacylglyceride acyltransferase 1 (LS_DGAT1) and pKR1323 (SEQ ID NO:289, Example 30), comprising *Yarrowia* DGAT1 codon optimized for expression in soy (YL_DGAT1 cod2), in soy somatic embryos (Experiment numbers MSE2351, MSE2349, MSE2352 and MSE2350, respectively).

Events from each experiment were selected, somatic embryos were matured in SHaM and oil concentrations and fatty acid profiles were determined as described in Example 5. Results for MSE2349, MSE2350, MSE2351 and 2352 are shown in Table 65, Table 66, Table 67 and Table 68, respectively.

TABLE 65

Oil concentrations and fatty acid profiles for events from MSE2349 MSE2349 (YL DGAT2)

| Event | 16:0 | 18:0 | 18:1 | 18:2 | 18:3 | % Oil |
|---|---|---|---|---|---|---|
| 2349-3 | 10.3 | 4.1 | 42.5 | 37.0 | 6.1 | 17.3 |
| 2349-29 | 11.8 | 4.4 | 32.6 | 43.2 | 8.2 | 15.1 |
| 2349-17 | 11.5 | 4.0 | 34.5 | 42.1 | 8.0 | 15.0 |
| 2349-22 | 10.8 | 4.9 | 34.1 | 42.2 | 8.0 | 14.6 |
| 2349-11 | 11.5 | 4.9 | 34.1 | 41.9 | 7.6 | 14.1 |
| 2349-27 | 13.0 | 4.5 | 31.0 | 43.0 | 8.5 | 13.6 |
| 2349-26 | 13.6 | 3.7 | 28.0 | 45.6 | 9.1 | 12.7 |
| 2349-14 | 12.9 | 5.0 | 30.0 | 43.1 | 9.1 | 12.0 |
| 2349-25 | 14.7 | 4.4 | 20.6 | 49.9 | 10.4 | 11.9 |
| 2349-2 | 12.4 | 6.4 | 39.5 | 33.9 | 7.8 | 11.1 |
| 2349-5 | 15.3 | 3.6 | 20.7 | 48.2 | 12.3 | 10.8 |
| 2349-24 | 14.5 | 5.2 | 26.0 | 43.5 | 10.8 | 10.5 |
| 2349-21 | 12.6 | 6.9 | 35.2 | 36.0 | 9.4 | 10.3 |
| 2349-6 | 13.0 | 6.1 | 33.6 | 38.2 | 9.2 | 10.3 |
| 2349-16 | 14.6 | 4.5 | 23.8 | 46.1 | 11.1 | 10.2 |
| 2349-1 | 12.8 | 5.1 | 32.0 | 39.7 | 10.4 | 9.9 |
| 2349-23 | 15.1 | 4.0 | 23.0 | 46.6 | 11.3 | 9.9 |
| 2349-20 | 14.1 | 5.1 | 23.2 | 46.0 | 11.6 | 9.7 |
| 2349-18 | 14.2 | 4.4 | 24.4 | 45.0 | 12.1 | 9.2 |
| 2349-19 | 14.5 | 6.1 | 26.8 | 41.7 | 10.9 | 9.2 |
| 2349-28 | 13.2 | 7.4 | 33.4 | 35.7 | 10.3 | 9.2 |
| 2349-4 | 14.7 | 4.4 | 25.0 | 44.7 | 11.2 | 8.6 |
| 2349-12 | 17.9 | 3.9 | 17.0 | 47.7 | 13.5 | 8.6 |
| 2349-10 | 15.7 | 6.7 | 22.8 | 41.6 | 13.1 | 8.3 |
| 2349-15 | 17.6 | 5.1 | 21.9 | 43.5 | 11.9 | 8.1 |
| 2349-8 | 13.8 | 5.4 | 22.5 | 43.0 | 15.2 | 8.1 |
| 2349-30 | 14.8 | 4.5 | 27.7 | 39.6 | 13.6 | 8.0 |
| 2349-9 | 14.9 | 6.5 | 26.9 | 39.7 | 12.1 | 7.7 |
| 2349-13 | 15.0 | 5.1 | 25.0 | 39.6 | 15.3 | 6.7 |
| 2349-7 | 16.3 | 4.5 | 20.8 | 42.1 | 16.3 | 5.7 |
| Avg. | 13.9 | 5.0 | 27.9 | 42.3 | 10.8 | 10.5 |

TABLE 66

Oil concentrations and fatty acid profiles for events from MSE2350 MSE2350 (YL DGAT1cod2)

| Event | 16:0 | 18:0 | 18:1 | 18:2 | 18:3 | % Oil |
|---|---|---|---|---|---|---|
| 2350-4 | 10.7 | 3.9 | 34.7 | 44.7 | 5.9 | 18.6 |
| 2350-20 | 9.9 | 3.9 | 45.0 | 34.9 | 6.3 | 17.7 |
| 2350-6 | 10.5 | 4.7 | 40.2 | 38.8 | 5.7 | 17.3 |
| 2350-29 | 11.0 | 4.7 | 37.8 | 40.5 | 6.0 | 16.6 |
| 2350-5 | 10.8 | 5.3 | 37.0 | 39.8 | 7.1 | 13.8 |
| 2350-1 | 11.4 | 5.4 | 37.1 | 38.5 | 7.5 | 13.7 |
| 2350-23 | 12.9 | 5.4 | 32.9 | 41.3 | 7.6 | 12.4 |
| 2350-17 | 12.3 | 7.5 | 35.9 | 37.0 | 7.4 | 12.4 |
| 2350-24 | 14.2 | 4.1 | 22.7 | 47.9 | 11.0 | 11.7 |
| 2350-3 | 14.0 | 5.4 | 30.6 | 40.3 | 9.6 | 11.7 |
| 2350-12 | 13.4 | 6.6 | 27.8 | 42.9 | 9.4 | 11.3 |
| 2350-18 | 14.4 | 4.1 | 21.1 | 49.2 | 11.1 | 11.1 |
| 2350-14 | 14.6 | 3.2 | 21.3 | 49.3 | 11.7 | 10.9 |
| 2350-30 | 13.8 | 6.9 | 29.1 | 40.3 | 9.9 | 10.6 |
| 2350-26 | 14.2 | 5.8 | 26.3 | 43.3 | 10.5 | 10.5 |
| 2350-21 | 12.9 | 5.8 | 28.5 | 42.7 | 10.2 | 10.1 |
| 2350-16 | 15.2 | 5.2 | 22.3 | 46.3 | 11.0 | 9.5 |
| 2350-19 | 13.7 | 5.2 | 27.7 | 41.7 | 11.6 | 9.5 |
| 2350-13 | 14.7 | 5.1 | 24.6 | 43.9 | 11.8 | 9.0 |
| 2350-7 | 14.7 | 6.4 | 25.8 | 41.2 | 11.9 | 8.9 |
| 2350-2 | 13.3 | 5.6 | 31.9 | 38.0 | 11.2 | 8.2 |
| 2350-27 | 15.9 | 5.3 | 23.0 | 42.7 | 13.1 | 7.9 |
| 2350-28 | 16.4 | 5.9 | 27.0 | 38.3 | 12.4 | 7.6 |
| 2350-22 | 15.3 | 6.4 | 23.6 | 42.1 | 12.5 | 7.6 |
| 2350-25 | 13.8 | 4.8 | 24.0 | 42.7 | 14.6 | 7.5 |
| 2350-31 | 16.6 | 4.5 | 21.1 | 43.8 | 14.0 | 7.3 |
| 2350-11 | 14.8 | 5.9 | 22.3 | 43.0 | 14.0 | 7.2 |
| 2350-8 | 16.1 | 5.4 | 22.6 | 40.5 | 15.3 | 6.5 |
| 2350-10 | 15.5 | 5.9 | 22.1 | 41.3 | 15.2 | 6.0 |
| 2350-9 | 15.4 | 5.8 | 20.6 | 41.6 | 16.6 | 5.2 |
| 2350-15 | 15.1 | 4.5 | 17.1 | 43.1 | 20.1 | 5.1 |
| Avg. | 13.8 | 5.3 | 27.9 | 42.0 | 11.0 | 10.4 |

TABLE 67

Oil concentrations and fatty acid profiles for events from MSE2351 MSE2351 (PR DGAT2)

| Event | 16:0 | 18:0 | 18:1 | 18:2 | 18:3 | % Oil |
|---|---|---|---|---|---|---|
| 2351-28 | 15.2 | 4.2 | 21.9 | 48.7 | 10.0 | 12.3 |
| 2351-9 | 14.8 | 3.9 | 22.0 | 48.0 | 11.3 | 12.0 |
| 2351-24 | 14.8 | 4.3 | 21.9 | 49.1 | 9.9 | 11.2 |
| 2351-11 | 15.3 | 5.0 | 23.8 | 45.6 | 10.3 | 10.8 |
| 2351-25 | 14.4 | 6.0 | 23.9 | 44.6 | 11.2 | 10.6 |
| 2351-21 | 15.3 | 5.6 | 24.4 | 44.0 | 10.7 | 10.5 |
| 2351-30 | 14.7 | 5.9 | 25.3 | 43.9 | 10.2 | 10.1 |
| 2351-1 | 13.9 | 6.8 | 25.1 | 44.2 | 10.0 | 10.1 |
| 2351-10 | 15.3 | 7.1 | 24.8 | 42.8 | 10.0 | 10.1 |
| 2351-13 | 14.9 | 7.0 | 25.9 | 42.8 | 9.4 | 10.0 |
| 2351-23 | 14.7 | 6.6 | 25.3 | 42.6 | 10.7 | 9.6 |
| 2351-18 | 15.3 | 5.0 | 23.0 | 46.4 | 10.3 | 9.5 |
| 2351-12 | 15.1 | 4.1 | 17.4 | 50.7 | 12.8 | 9.2 |
| 2351-3 | 15.4 | 7.2 | 25.1 | 42.1 | 10.3 | 8.8 |
| 2351-15 | 15.1 | 4.9 | 22.6 | 46.1 | 11.3 | 8.7 |
| 2351-5 | 15.7 | 7.4 | 23.5 | 42.2 | 11.1 | 8.6 |
| 2351-16 | 15.6 | 5.7 | 23.4 | 43.9 | 11.4 | 8.4 |
| 2351-6 | 14.8 | 6.1 | 25.7 | 42.5 | 10.9 | 8.0 |
| 2351-20 | 15.6 | 6.4 | 25.3 | 41.2 | 11.6 | 8.0 |
| 2351-29 | 17.6 | 5.4 | 19.9 | 43.9 | 13.2 | 8.0 |
| 2351-22 | 15.1 | 7.0 | 25.8 | 40.4 | 11.7 | 7.9 |
| 2351-4 | 15.5 | 6.6 | 23.1 | 41.6 | 13.1 | 7.8 |
| 2351-2 | 15.4 | 6.6 | 24.3 | 41.4 | 12.4 | 7.7 |
| 2351-8 | 15.6 | 6.6 | 24.9 | 39.1 | 13.8 | 6.7 |
| 2351-26 | 15.8 | 6.4 | 23.0 | 40.3 | 14.5 | 6.7 |
| 2351-14 | 11.8 | 4.0 | 20.7 | 50.0 | 13.4 | 6.3 |
| 2351-17 | 17.3 | 5.6 | 21.3 | 39.8 | 16.0 | 5.3 |
| 2351-19 | 16.4 | 6.4 | 23.0 | 40.1 | 14.2 | 5.3 |
| 2351-7 | 14.5 | 5.9 | 21.6 | 40.3 | 17.6 | 4.9 |
| 2351-27 | 16.5 | 6.4 | 22.8 | 40.1 | 14.1 | 4.9 |
| Avg. | 15.2 | 5.9 | 23.4 | 43.6 | 11.9 | 8.6 |

TABLE 68

Oil concentrations and fatty acid profiles for events from MSE2352 MSE2352 (LS DGAT1)

| Event | 16:0 | 18:0 | 18:1 | 18:2 | 18:3 | % Oil |
|---|---|---|---|---|---|---|
| 2352-4 | 13.2 | 4.4 | 28.1 | 45.4 | 8.9 | 14.0 |
| 2352-6 | 12.4 | 5.8 | 30.3 | 43.3 | 8.1 | 13.6 |
| 2352-27 | 14.3 | 7.6 | 32.9 | 37.4 | 7.9 | 12.9 |
| 2352-8 | 14.9 | 4.5 | 21.3 | 49.0 | 10.4 | 12.1 |
| 2352-24 | 13.2 | 7.5 | 31.0 | 39.6 | 8.7 | 12.1 |
| 2352-5 | 13.7 | 7.8 | 29.9 | 40.0 | 8.6 | 12.0 |
| 2352-30 | 14.4 | 5.9 | 30.0 | 40.6 | 9.1 | 11.9 |
| 2352-29 | 14.0 | 6.1 | 31.5 | 39.3 | 9.1 | 11.7 |
| 2352-22 | 14.4 | 4.7 | 24.6 | 46.4 | 9.9 | 11.6 |
| 2352-28 | 14.4 | 7.4 | 28.3 | 40.8 | 9.1 | 11.5 |
| 2352-12 | 14.4 | 7.5 | 29.0 | 39.4 | 9.7 | 11.1 |
| 2352-19 | 14.5 | 6.1 | 30.5 | 38.7 | 10.2 | 10.9 |
| 2352-7 | 14.2 | 7.0 | 24.9 | 44.2 | 9.7 | 10.9 |
| 2352-21 | 15.5 | 6.8 | 25.4 | 42.0 | 10.3 | 10.6 |
| 2352-1 | 14.7 | 8.0 | 27.7 | 39.5 | 10.1 | 10.2 |
| 2352-9 | 15.0 | 5.7 | 22.7 | 44.5 | 12.2 | 9.3 |
| 2352-13 | 12.6 | 5.4 | 27.8 | 42.8 | 11.3 | 9.2 |
| 2352-11 | 14.7 | 7.8 | 26.8 | 40.2 | 10.6 | 9.1 |
| 2352-16 | 16.3 | 6.0 | 23.5 | 42.0 | 12.2 | 9.1 |
| 2352-18 | 15.2 | 5.9 | 26.7 | 40.4 | 11.9 | 8.7 |
| 2352-14 | 15.8 | 5.2 | 21.4 | 44.8 | 12.8 | 8.5 |
| 2352-15 | 15.2 | 6.2 | 23.5 | 42.2 | 12.8 | 8.3 |
| 2352-10 | 16.2 | 6.3 | 24.5 | 39.8 | 13.2 | 7.9 |
| 2352-25 | 15.4 | 5.3 | 26.5 | 40.4 | 12.4 | 7.8 |
| 2352-26 | 18.9 | 5.0 | 18.5 | 45.1 | 12.6 | 7.7 |
| 2352-23 | 15.2 | 8.1 | 25.5 | 39.4 | 11.8 | 7.4 |
| 2352-3 | 16.1 | 7.0 | 23.8 | 39.8 | 13.3 | 7.0 |
| 2352-17 | 15.0 | 6.3 | 24.7 | 39.9 | 14.1 | 6.5 |
| 2352-31 | 17.1 | 6.3 | 22.0 | 41.5 | 13.1 | 6.3 |
| 2352-32 | 16.8 | 7.2 | 26.8 | 37.2 | 12.1 | 6.1 |
| 2352-2 | 16.5 | 7.2 | 23.1 | 39.6 | 13.7 | 5.9 |
| 2352-20 | 16.0 | 7.2 | 26.5 | 36.3 | 14.0 | 5.2 |
| Avg. | 15.0 | 6.4 | 26.2 | 41.3 | 11.1 | 9.6 |

LS_DGAT1 and YL_DGAT1 (cod2) increase oil and oleic acid concentration in somatic embryos to amounts similar to YL DGAT2. PR_DGAT2 increases oil and oleic to a slightly lesser extent than YL_DGAT2. It is noted that absolute concentrations (expressed as averages) may vary using the same genes but in different separate experiments conducted at different times. For example, YL_DGAT2 gave an average oil concentration of 7.5% in MSE2334 (Example 37) but gives 10.5% in MSE2349. In all cases, average % Oil for any individual gene in an experiment can be compared to that obtained for YL_DGAT2 which is run in all experiments as a control and thus normalizes results between expermimental sets.

Example 39

Expression and Functional Analysis of DGAT2s from *Yarrowia lipolyitica*, *Cryptococcus curvatus*, *Mucor circinelloides* and *Candida zeylanoides* in Soybean Somatic Embryos The present example describes construction of pKR1392, comprising *Candida zeylanoides* diacylglyceride acyltransferase 2 (CZ_DGAT2); pKR1409, comprising *Mucor circinelloides* diacylglyceride acyltransferase 2 (MC_DGAT2); and pKR1427, comprising *Cryptococcus curvatus* diacylglyceride acyltransferase 2 (CC_DGAT2) and expression in somatic embryos. Control vector pKR1256 (SEQ ID NO:98; Example 16), comprising *Yarrowia* DGAT2 (YL_DGAT2), was also expressed for comparison.

Construction of pKR1392, Comprising Cz DGAT2
CZ_DGAT2 (SEQ ID NO:175, Example 21) was amplified from an isolated cosmid containing the genomic DNA fragment (described in Example 21) with oligonucleotide primers CzDGAT2-5 (SEQ ID NO:352) and CzDGAT2-3 (SEQ ID NO:353), using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pHD39 (SEQ ID NO:354).

The NotI fragment of pKRHD39 (SEQ ID NO:354), containing CZ_DGAT2, was cloned into the NotI site of pKR72 (SEQ ID NO:26; Example 4) to produce pKR1392 (SEQ ID NO:355).

Construction of pKR1409, Comprising MC DGAT2

MC_DGAT2 (SEQ ID NO:233, Example 26) was amplified from cDNA described in Example 26 with oligonucleotide primers oMcDG2-1 (SEQ ID NO:356) and oMcDG2-2 (SEQ ID NO:357), using the Phusion™ High-Fidelity DNA Polymerase (Cat. No. F553S, Finnzymes Oy, Finland) following the manufacturer's protocol. The resulting DNA fragment was cloned into the pCR-Blunt® cloning vector using the Zero Blunt® PCR Cloning Kit (Invitrogen Corporation), following the manufacturer's protocol, to produce pKR1408 (SEQ ID NO:358). The nucleotide sequence of MC_DGAT2 from pKR1408 is set forth in SEQ ID NO:359 and has one nt change compared to SEQ ID NO:233 which does not alter the aa sequence.

The NotI fragment of pKR1408 (SEQ ID NO:358), containing MC_DGAT2, was cloned into the NotI site of pKR72 (SEQ ID NO:26; Example 4) to produce pKR1409 (SEQ ID NO:360).

Construction of pKR1427, Comprising CC DGAT2

The plasmid containing the CC_DGAT2 gene described in Example 36 was digested with NotI and the fragment containing CC_DGAT2 was cloned into the NotI site of pKR72 (SEQ ID NO:26; Example 4) to produce pKR1427 (SEQ ID NO:361).

Expression of CZ_DGAT2. MC DGAT2 and CC DGAT2 in Soy Somatic Embryos

Soybean embryogenic suspension culture (cv. Jack) was transformed with pKR1392 (SEQ ID NO:355), having experiment number MSE2451; with pKR1409 (SEQ ID NO:360), having experiment number MSE2452 and with pKR1427 (SEQ ID NO:361), having experiment number MSE2453. Control vector pKR1256 (SEQ ID NO:98; Example 16), comprising *Yarrowia* DGAT2 (YL_DGAT2), was also transformed alone in a similar way for a control and has experiment number MSE2454. Events were selected and somatic embryos matured in SHaM as described in Example 5. Oil concentrations and fatty acid profiles were determined as described in Example 5 for MSE2451, MSE2452, MSE 2453 and MSE2454 and results for each experiment are shown in Table 69, Table 70, Table 71 and Table 72, respectively.

TABLE 69

Oil concentrations and fatty acid profiles for events from MSE2451 MSE2451 (CZ DGAT2)

| Event | 16:0 | 18:0 | 18:1 | 18:2 | 18:3 | % Oil |
|---|---|---|---|---|---|---|
| 2451-13 | 16.2 | 5.3 | 17.0 | 38.1 | 23.4 | 7.0 |
| 2451-7 | 16.8 | 4.8 | 13.5 | 41.2 | 23.6 | 5.8 |
| 2451-26 | 15.3 | 6.3 | 21.4 | 40.3 | 16.7 | 5.3 |
| 2451-25 | 15.7 | 5.5 | 16.6 | 39.4 | 22.8 | 5.2 |
| 2451-24 | 15.4 | 5.1 | 15.0 | 40.9 | 23.6 | 5.0 |
| 2451-31 | 15.6 | 5.7 | 18.7 | 42.4 | 17.5 | 4.9 |

TABLE 69-continued

Oil concentrations and fatty acid profiles for events from MSE2451 MSE2451 (CZ DGAT2)

| Event | 16:0 | 18:0 | 18:1 | 18:2 | 18:3 | % Oil |
|---|---|---|---|---|---|---|
| 2451-14 | 15.7 | 6.3 | 22.7 | 37.9 | 17.4 | 4.9 |
| 2451-12 | 16.6 | 6.2 | 21.1 | 38.5 | 17.6 | 4.7 |
| 2451-30 | 16.7 | 5.2 | 17.0 | 41.4 | 19.7 | 4.6 |
| 2451-3 | 15.9 | 6.3 | 21.1 | 39.3 | 17.4 | 4.5 |
| 2451-9 | 14.4 | 6.6 | 24.8 | 36.4 | 17.9 | 4.4 |
| 2451-17 | 16.7 | 5.8 | 18.6 | 41.2 | 17.8 | 4.4 |
| 2451-15 | 14.4 | 7.7 | 24.6 | 37.7 | 15.6 | 4.3 |
| 2451-10 | 16.2 | 6.2 | 20.6 | 38.8 | 18.2 | 4.3 |
| 2451-2 | 15.2 | 5.3 | 16.5 | 42.1 | 20.9 | 4.1 |
| 2451-21 | 16.9 | 5.8 | 18.8 | 36.6 | 21.9 | 4.0 |
| 2451-4 | 16.8 | 6.7 | 22.6 | 36.1 | 17.8 | 4.0 |
| 2451-16 | 17.1 | 6.2 | 16.4 | 38.3 | 22.0 | 3.9 |
| 2451-28 | 16.2 | 5.3 | 17.4 | 40.6 | 20.5 | 3.9 |
| 2451-1 | 17.1 | 5.1 | 15.5 | 40.0 | 22.3 | 3.8 |
| 2451-6 | 17.8 | 4.8 | 11.3 | 41.3 | 24.9 | 3.8 |
| 2451-22 | 15.2 | 7.4 | 15.6 | 40.0 | 21.6 | 3.7 |
| 2451-20 | 16.0 | 6.2 | 21.4 | 37.7 | 18.7 | 3.7 |
| 2451-8 | 16.3 | 5.2 | 17.0 | 39.8 | 21.8 | 3.7 |
| 2451-18 | 16.2 | 5.5 | 19.9 | 40.0 | 18.3 | 3.5 |
| 2451-23 | 16.8 | 5.2 | 16.5 | 39.6 | 21.9 | 3.3 |
| 2451-29 | 16.7 | 5.0 | 16.5 | 39.2 | 22.7 | 3.3 |
| 2451-5 | 17.2 | 6.1 | 18.0 | 39.0 | 19.7 | 3.2 |
| 2451-27 | 16.4 | 5.2 | 16.2 | 39.1 | 23.2 | 3.1 |
| 2451-11 | 16.2 | 5.0 | 15.4 | 41.0 | 22.5 | 3.0 |
| 2451-19 | 16.7 | 5.2 | 15.8 | 38.7 | 23.6 | 2.7 |
| Avg. | 16.2 | 5.7 | 18.2 | 39.4 | 20.4 | 4.2 |

TABLE 70

Oil concentrations and fatty acid profiles for events from MSE2452 MSE2452 (MC DGAT2)

| Event | 16:0 | 18:0 | 18:1 | 18:2 | 18:3 | % Oil |
|---|---|---|---|---|---|---|
| 2452-6 | 16.6 | 5.3 | 20.9 | 41.0 | 16.2 | 5.6 |
| 2452-22 | 15.6 | 6.6 | 24.7 | 39.2 | 13.9 | 5.5 |
| 2452-13 | 16.8 | 7.1 | 28.1 | 35.1 | 13.0 | 5.4 |
| 2452-12 | 16.8 | 5.5 | 22.9 | 39.1 | 15.8 | 5.1 |
| 2452-3 | 16.8 | 5.0 | 22.0 | 39.9 | 16.3 | 5.1 |
| 2452-25 | 16.1 | 4.7 | 23.7 | 38.4 | 17.1 | 5.0 |
| 2452-29 | 16.2 | 5.1 | 25.2 | 36.9 | 16.7 | 4.8 |
| 2452-20 | 17.1 | 5.3 | 20.7 | 38.1 | 18.8 | 4.8 |
| 2452-11 | 16.8 | 5.2 | 24.6 | 37.2 | 16.3 | 4.8 |
| 2452-2 | 17.0 | 5.3 | 22.4 | 38.0 | 17.2 | 4.7 |
| 2452-8 | 16.5 | 4.4 | 22.4 | 39.3 | 17.4 | 4.7 |
| 2452-4 | 17.5 | 4.9 | 21.5 | 37.3 | 18.8 | 4.7 |
| 2452-28 | 17.3 | 4.4 | 19.2 | 40.5 | 18.7 | 4.6 |
| '2452-1 | 16.3 | 5.6 | 26.5 | 35.1 | 16.5 | 4.5 |
| 2452-31 | 17.6 | 5.7 | 22.6 | 38.0 | 16.2 | 4.4 |
| 2452-27 | 16.5 | 5.7 | 25.5 | 35.7 | 16.6 | 4.4 |
| 2452-23 | 18.5 | 6.3 | 23.1 | 36.0 | 16.0 | 4.3 |
| 2452-21 | 16.9 | 5.8 | 21.7 | 38.5 | 17.1 | 4.2 |
| 2452-5 | 16.4 | 5.3 | 24.1 | 36.1 | 18.1 | 4.0 |
| 2452-16 | 17.8 | 5.7 | 21.9 | 37.8 | 16.8 | 3.9 |
| 2452-14 | 17.3 | 5.3 | 24.3 | 35.8 | 17.3 | 3.9 |
| 2452-26 | 16.8 | 4.4 | 18.0 | 41.4 | 19.3 | 3.9 |
| 2452-18 | 16.7 | 4.5 | 16.4 | 39.0 | 23.4 | 3.8 |
| 2452-24 | 19.4 | 4.8 | 13.7 | 40.1 | 22.0 | 3.7 |
| 2452-9 | 16.8 | 5.1 | 13.6 | 42.8 | 21.7 | 3.6 |
| 2452-7 | 18.7 | 4.8 | 16.7 | 37.8 | 21.8 | 3.4 |
| 2452-15 | 17.5 | 5.3 | 18.4 | 38.2 | 20.7 | 3.0 |
| 2452-30 | 19.3 | 5.5 | 17.8 | 37.9 | 19.5 | 3.0 |
| 2452-10 | 17.1 | 5.6 | 19.4 | 37.1 | 20.8 | 2.5 |
| Avg. | 17.1 | 5.3 | 21.4 | 38.2 | 17.9 | 4.3 |

TABLE 71

Oil concentrations and fatty acid profiles for events from MSE2453 MSE2453 (CC DGAT2)

| Event | 16:0 | 18:0 | 18:1 | 18:2 | 18:3 | % Oil |
|---|---|---|---|---|---|---|
| 2453-11 | 16.1 | 6.0 | 22.5 | 40.2 | 15.3 | 5.6 |
| 2453-25 | 17.2 | 5.0 | 17.3 | 42.8 | 17.6 | 5.1 |
| 2453-12 | 16.3 | 6.1 | 23.0 | 39.1 | 15.4 | 5.1 |
| 2453-29 | 16.9 | 4.7 | 16.2 | 41.1 | 21.1 | 5.1 |
| 2453-15 | 17.5 | 4.2 | 12.2 | 45.2 | 20.9 | 4.7 |
| 2453-13 | 18.8 | 5.6 | 20.5 | 37.8 | 17.3 | 4.5 |
| 2453-2 | 17.3 | 5.4 | 19.7 | 38.0 | 19.6 | 4.4 |
| 2453-26 | 16.5 | 4.8 | 18.6 | 38.0 | 22.1 | 4.3 |
| 2453-7 | 17.6 | 5.4 | 19.4 | 39.7 | 18.0 | 4.3 |
| 2453-20 | 17.3 | 4.7 | 16.0 | 39.9 | 22.1 | 4.1 |
| 2453-8 | 18.2 | 6.1 | 22.9 | 35.9 | 16.8 | 4.1 |
| 2453-6 | 17.1 | 5.0 | 20.2 | 38.2 | 19.5 | 4.1 |
| 2453-24 | 17.7 | 5.0 | 14.9 | 40.9 | 21.5 | 4.1 |
| 2453-14 | 17.6 | 5.1 | 19.8 | 38.6 | 18.9 | 4.0 |
| 2453-22 | 19.2 | 4.4 | 12.6 | 39.4 | 24.5 | 4.0 |
| 2453-28 | 18.2 | 5.4 | 21.5 | 37.0 | 17.9 | 4.0 |
| 2453-18 | 18.0 | 5.7 | 16.5 | 39.3 | 20.4 | 3.9 |
| 2453-21 | 19.6 | 5.9 | 19.1 | 37.0 | 18.4 | 3.9 |
| 2453-10 | 17.4 | 5.1 | 15.4 | 39.8 | 22.4 | 3.8 |
| 2453-17 | 18.0 | 5.6 | 15.9 | 40.8 | 19.7 | 3.7 |
| 2453-5 | 17.2 | 4.0 | 11.1 | 43.4 | 24.1 | 3.5 |
| 2453-23 | 18.1 | 4.9 | 15.1 | 41.4 | 20.6 | 3.4 |
| 2453-3 | 17.7 | 5.0 | 15.5 | 39.7 | 22.0 | 3.3 |
| 2453-9 | 18.6 | 5.6 | 18.3 | 36.0 | 21.6 | 3.2 |
| 2453-4 | 17.5 | 5.0 | 15.3 | 40.1 | 22.0 | 3.2 |
| 2453-16 | 17.2 | 5.7 | 25.1 | 32.1 | 20.0 | 2.8 |
| 2453-30 | 16.9 | 4.6 | 17.7 | 37.5 | 23.2 | 2.6 |
| 2453-19 | 20.6 | 4.4 | 12.0 | 38.4 | 24.5 | 2.3 |
| Avg. | 17.7 | 5.2 | 17.6 | 39.2 | 20.3 | 4.0 |

TABLE 72

Oil concentrations and fatty acid profiles for events from MSE2454 MSE2454 (YL DGAT2)

| Event | 16:0 | 18:0 | 18:1 | 18:2 | 18:3 | % Oil |
|---|---|---|---|---|---|---|
| 2454-27 | 12.2 | 6.0 | 35.5 | 36.8 | 9.4 | 9.5 |
| 2455-5 | 13.9 | 5.9 | 32.6 | 36.9 | 10.8 | 8.2 |
| 2454-13 | 13.6 | 5.8 | 29.4 | 38.9 | 12.3 | 8.0 |
| 2454-29 | 14.1 | 5.4 | 29.7 | 37.6 | 13.2 | 7.9 |
| 2454-26 | 14.5 | 6.3 | 33.8 | 33.9 | 11.5 | 7.3 |
| 2454-24 | 14.9 | 5.9 | 28.2 | 38.6 | 12.4 | 7.0 |
| 2454-17 | 15.3 | 5.1 | 27.0 | 38.7 | 13.9 | 6.6 |
| 2454-9 | 14.1 | 6.0 | 31.0 | 36.8 | 12.1 | 6.6 |
| 2454-15 | 14.6 | 5.9 | 23.0 | 39.5 | 16.9 | 6.4 |
| 2454-10 | 16.1 | 6.4 | 27.4 | 36.2 | 14.0 | 5.8 |
| 2454-2 | 17.0 | 5.2 | 22.0 | 40.3 | 15.5 | 5.8 |
| 2454-1 | 15.8 | 6.0 | 26.4 | 37.4 | 14.4 | 5.7 |
| 2455-4 | 17.2 | 5.7 | 23.6 | 37.8 | 15.8 | 5.5 |
| 2454-7 | 15.4 | 5.6 | 23.6 | 39.1 | 16.4 | 5.4 |
| 2454-8 | 15.8 | 5.5 | 28.8 | 35.8 | 14.0 | 5.3 |
| 2454-18 | 17.4 | 6.3 | 21.7 | 37.6 | 17.0 | 5.2 |
| 2454-3 | 17.8 | 5.9 | 23.0 | 38.3 | 14.9 | 5.1 |
| 2454-16 | 16.5 | 5.4 | 21.0 | 40.8 | 16.3 | 5.0 |
| 2454-23 | 17.3 | 4.5 | 19.5 | 40.4 | 18.3 | 4.9 |
| 2454-11 | 16.8 | 5.6 | 24.3 | 36.3 | 17.0 | 4.8 |
| 2454-25 | 16.8 | 6.0 | 20.9 | 38.2 | 18.1 | 4.8 |
| 2455-7 | 17.3 | 5.4 | 24.2 | 38.1 | 15.0 | 4.7 |
| 2454-4 | 17.5 | 6.7 | 21.9 | 37.7 | 16.2 | 4.7 |
| 2455-6 | 17.2 | 5.3 | 19.9 | 39.3 | 18.3 | 4.7 |
| 2454-14 | 16.5 | 5.8 | 23.1 | 37.4 | 17.2 | 4.4 |
| 2454-6 | 17.6 | 6.1 | 25.6 | 35.3 | 15.4 | 4.4 |
| 2454-21 | 16.6 | 4.4 | 20.9 | 38.1 | 20.0 | 3.9 |
| 2454-19 | 18.4 | 5.0 | 17.6 | 40.4 | 18.6 | 3.7 |
| 2454-30 | 16.6 | 4.1 | 15.0 | 40.9 | 23.3 | 3.6 |
| 2454-31 | 17.3 | 4.1 | 11.4 | 43.3 | 23.8 | 3.6 |
| 2454-28 | 17.5 | 5.0 | 19.7 | 37.5 | 20.2 | 3.5 |
| 2454-22 | 17.5 | 4.8 | 19.6 | 39.7 | 18.4 | 3.4 |
| Avg. | 16.2 | 5.5 | 24.1 | 38.2 | 16.0 | 5.5 |

The wild-type CZ_DGAT2, MC_DAGT2 and CC_DGAT2 do not appear to affect oil or oleic acid concentration in somatic embryos when compared to YL DGAT2.

Example 40

Expression Optimized DGAT2 Gene Sequences Encoding a CC DGAT2 Protein Variant

The nucleotide sequence encoding the DGAT2 protein from *Cryptococcus curvatus* described herein (see previous Example 36) was re-designed for optimized expression in soybean seed using methods similar to those described in Wu, G et al. *Nucleic Acids Research* (2007), 35: D76-D79; Villalobos, A. et al. *BMC Bioinformatics* (2006), 7 No pp. given; Wu, G. et al. *Protein Expression and Purification* (2006), 47: 441-445; Richardson, S. M. et al. *Genome Research* (2006), 16: 550-556; Jayaraj, S. et al. *Nucleic Acids Research* (2005) 33: 3011-3016. DNA molecules were synthesized by either Codon Devices (MA, USA) or by GENEART AG (Regensburg, Germany). The expression-optimized DNA sequence and DGAT2 protein encoded by said DNA sequence are shown in SEQ ID NO:362 and SEQ ID NO:363, respectively. The protein encoded by the codon-optimized CC_DGAT2 sequence contains the motif FxxPxFR that was altered from FxxPxYR present in the native DGAT2 protein.

Example 41

Cloning Codon-Optimized DGAT Sequences for Expression in Soy

The present example describes the cloning of DGAT sequences which were codon-optimized, and motif-altered in the case of DGAT2s, for expression in soy into soy expression vectors.

All DGAT sequences that were codon-optimized for expression in soy, as described in Examples 33, 34 and 40, were synthesized with NotI restriction enzyme sites flanking the codon-optimized gene sequence (before start codon and after stop codon). In addition, three nucleotides (ACC) were added between with NotI at the 5' end of codon-optimized gene and the ATG start codon in all cases.

The NotI fragments of each synthesized codon-optimized DGAT gene sequence were cloned into the NotI site of pKR72 (SEQ ID NO:26; Example 4) to produce soy expression vectors. The vector sequences for all wild-type and codon-optimized gene sequences are summarized in Table 73.

TABLE 73

Summary of wild-type and codon-optimized sequences and vectors

| Gene | nt SEQ ID NO: | aa SEQ ID NO: | Expression Vector | Vector SEQ ID NO: |
|---|---|---|---|---|
| TD_DGAT2A | 133 | 135 | pKR1324 | 121 |
| TD_DGAT2Acod | 303 | 304 | pKR1422 | 364 |
| TD_DGAT2B | 134 | 136 | pKR1325 | 134 |
| TD_DGAT2Bcod | 305 | 306 | N/A | N/A |
| PA_DGAT2 | 146 | 147 | pKR1332 | 260 |
| PA_DGAT2cod | 307 | 308 | pKR1421 | 365 |
| DH_DGAT2 | 161 | 162 | pKR1328 | 161 |
| DH_DGAT2cod | 309 | 310 | pKR1420 | 366 |
| CZ_DGAT2 | 175 | 176 | pKR1392 | 355 |
| CZ_DGAT2cod | 311 | 312 | pKR1512 | 367 |
| LS_DGAT2 | 271 | 272 | pKR1337 | 273 |
| LS_DGAT2cod | 313 | 314 | pKR1415 | 368 |

TABLE 73-continued

Summary of wild-type and codon-optimized sequences and vectors

| Gene | nt SEQ ID NO: | aa SEQ ID NO: | Expression Vector | Vector SEQ ID NO: |
|---|---|---|---|---|
| MC_DGAT2 | 233 | 234 | pKR1409 | 360 |
| MC_DGAT2cod | 315 | 316 | pKR1513 | 369 |
| PR_DGAT2 | 293 | 215 | pKR1372 | 294 |
| PR_DGAT2cod | 317 | 318 | pKR1416 | 370 |
| RG_DGAT2 | 264 | 265 | pKR1333 | 266 |
| RG_DGAT2cod | 319 | 320 | pKR1423 | 371 |
| MA_DGAT2 | 254 | 255 | pKR1335 | 256 |
| MA_DGAT2cod | 321 | 322 | pKR1419 | 372 |
| CC_DGAT2 | 350 | 351 | pKR1427 | 361 |
| CC_DGAT2cod | 362 | 363 | pKR1522 | 373 |
| LS_DGAT1 | 298 | 299 | pKR1375 | 300 |
| LS_DGAT1cod | 302 | identical to wt | pKR1514 | 374 |
| MA_DGAT1 | 278 | 279 | pKR1334 | 280 |
| MA_DGAT1cod | 301 | identical to wt | pKR1511 | 375 |

Example 42

Expression of Codon-Optimized and Wild-Type DGAT Sequences in Soy

The present example describes the expression and functional characterization of wild-type and codon-optimized DGAT sequences is soy somatic embryos.

Soybean embryogenic suspension culture (cv. Jack) was transformed with each of the soy expression vectors comprising wild-type or codon-optimized DGATs described in Table 73 (Example 41). Transformations were carried out in sets comparing wild-type genes to codon-optimized genes and generally four genes (2 wild-type, 2 codon-optimized) were compared at once. Events were selected and somatic embryos matured in SHaM as described in Example 5. Oil concentrations and fatty acid profiles were determined as described in Example 5.

Results for pKR1337 (LS_DGAT2; SEQ ID NO:273; Experiment MSE2411), pKR1415 (LS_DGAT2cod; SEQ ID NO:368; Experiment MSE2412), pKR1372 (PR_DGAT2; SEQ ID NO:294; Experiment MSE2413) and pKR1416 (PR_DGAT2cod; SEQ ID NO:370; Experiment MSE2414) are shown in Tables 74, Table 75, Table 76 and Table 77, respectively.

TABLE 74

Oil concentrations and fatty acid profiles for events from MSE2411 MSE2411 (LS DGAT2)

| Event | 16:0 | 18:0 | 18:1 | 18:2 | 18:3 | % Oil |
|---|---|---|---|---|---|---|
| 2411-24 | 15.7 | 5.0 | 27.3 | 41.9 | 10.2 | 10.8 |
| 2411-31 | 13.6 | 5.8 | 28.2 | 41.7 | 10.7 | 8.7 |
| 2411-32 | 13.7 | 5.6 | 28.6 | 41.4 | 10.7 | 8.6 |
| 2411-12 | 14.0 | 6.5 | 29.8 | 39.0 | 10.7 | 8.5 |
| 2411-17 | 16.6 | 5.6 | 21.3 | 42.9 | 13.6 | 7.7 |
| 2411-22 | 14.3 | 6.5 | 30.9 | 37.3 | 11.0 | 7.5 |
| 2411-21 | 16.0 | 6.9 | 27.2 | 36.8 | 13.2 | 6.3 |
| 2411-30 | 15.7 | 6.4 | 23.1 | 41.1 | 13.8 | 6.2 |
| 2411-5 | 16.9 | 6.6 | 26.3 | 37.3 | 12.9 | 6.0 |
| 2411-29 | 14.7 | 5.3 | 27.5 | 37.7 | 14.9 | 6.0 |
| 2411-5 | 16.9 | 6.4 | 21.1 | 41.5 | 14.1 | 5.7 |
| 2411-13 | 16.4 | 6.6 | 24.1 | 39.7 | 13.3 | 5.3 |
| 2411-27 | 17.0 | 5.1 | 21.1 | 40.1 | 16.6 | 5.2 |
| 2411-16 | 18.4 | 5.2 | 17.3 | 42.5 | 16.6 | 5.0 |
| 2411-23 | 17.9 | 6.2 | 20.2 | 40.2 | 15.4 | 5.0 |

TABLE 74-continued

Oil concentrations and fatty acid profiles for events from MSE2411 MSE2411 (LS DGAT2)

| Event | 16:0 | 18:0 | 18:1 | 18:2 | 18:3 | % Oil |
|---|---|---|---|---|---|---|
| 2411-6 | 16.6 | 4.8 | 18.2 | 42.7 | 17.7 | 5.0 |
| 2411-4 | 17.3 | 5.8 | 20.2 | 40.5 | 16.3 | 4.9 |
| 2411-20 | 15.4 | 5.9 | 25.3 | 38.0 | 15.4 | 4.9 |
| 2411-4 | 16.4 | 4.3 | 20.1 | 40.8 | 18.3 | 4.8 |
| 2411-2 | 17.3 | 5.0 | 18.4 | 41.4 | 17.9 | 4.7 |
| 2411-26 | 17.0 | 5.9 | 19.1 | 40.6 | 17.4 | 4.6 |
| 2411-25 | 16.5 | 5.4 | 22.7 | 39.0 | 16.4 | 4.6 |
| 2411-14 | 18.1 | 5.0 | 16.4 | 41.9 | 18.5 | 4.6 |
| 2411-15 | 16.7 | 5.8 | 23.2 | 37.9 | 16.4 | 4.5 |
| 2411-3 | 17.9 | 5.5 | 17.7 | 41.2 | 17.8 | 4.4 |
| 2411-1 | 16.3 | 5.0 | 19.9 | 40.4 | 18.4 | 4.4 |
| 2411-10 | 17.6 | 5.4 | 20.7 | 40.2 | 16.2 | 4.4 |
| 2411-3 | 17.3 | 5.7 | 19.3 | 40.8 | 16.9 | 3.9 |
| 2411-28 | 16.7 | 5.9 | 20.1 | 39.3 | 18.0 | 3.7 |
| 2411-18 | 17.3 | 4.5 | 16.1 | 41.4 | 20.7 | 3.6 |
| 2411-11 | 18.0 | 5.0 | 16.4 | 44.3 | 16.3 | 2.9 |
| 2411-19 | 18.9 | 5.1 | 17.2 | 39.6 | 19.1 | 2.4 |
| Avg. | 16.5 | 5.6 | 22.0 | 40.3 | 15.5 | 5.5 |

TABLE 75

Oil concentrations and fatty acid profiles for events from MSE2412 MSE2412 (LS DGAT2cod)

| Event | 16:0 | 18:0 | 18:1 | 18:2 | 18:3 | % Oil |
|---|---|---|---|---|---|---|
| 2412-13 | 16.1 | 5.9 | 22.9 | 41.4 | 13.7 | 6.8 |
| 2412-29 | 16.2 | 6.6 | 23.0 | 41.1 | 13.1 | 6.6 |
| 2412-3 | 17.0 | 5.2 | 19.7 | 42.7 | 15.5 | 6.5 |
| 2412-9 | 16.2 | 6.2 | 22.9 | 41.2 | 13.5 | 6.2 |
| 2412-25 | 16.0 | 6.0 | 24.7 | 39.1 | 14.2 | 6.2 |
| 2412-26 | 16.6 | 5.8 | 21.8 | 42.0 | 13.8 | 6.1 |
| 2412-16 | 16.4 | 8.0 | 24.9 | 37.1 | 13.5 | 5.6 |
| 2412-23 | 16.1 | 6.5 | 23.3 | 40.0 | 14.0 | 5.5 |
| 2412-15 | 16.7 | 6.2 | 22.2 | 40.2 | 14.8 | 5.5 |
| 2412-5 | 16.2 | 6.7 | 27.3 | 36.9 | 12.9 | 5.4 |
| 2412-10 | 15.8 | 7.1 | 23.7 | 39.0 | 14.4 | 4.9 |
| 2412-4 | 17.3 | 3.2 | 12.9 | 44.9 | 21.8 | 4.8 |
| 2412-21 | 17.0 | 5.7 | 20.6 | 40.2 | 16.6 | 4.7 |
| 2412-30 | 16.6 | 5.9 | 22.6 | 39.8 | 15.0 | 4.7 |
| 2412-20 | 16.6 | 6.9 | 22.8 | 39.0 | 14.7 | 4.6 |
| 2412-28 | 16.6 | 5.1 | 17.1 | 42.7 | 18.5 | 4.6 |
| 2412-11 | 17.1 | 7.4 | 24.6 | 36.5 | 14.3 | 4.4 |
| 2412-31 | 17.7 | 4.4 | 14.9 | 43.5 | 19.5 | 4.4 |
| 2412-24 | 16.6 | 6.8 | 23.7 | 37.4 | 15.4 | 4.4 |
| 2412-8 | 17.9 | 5.6 | 17.2 | 44.0 | 15.3 | 4.4 |
| 2412-1 | 17.3 | 6.0 | 21.3 | 40.0 | 15.3 | 4.4 |
| 2412-7 | 17.8 | 6.1 | 20.8 | 40.2 | 15.1 | 4.3 |
| 2412-17 | 17.8 | 4.7 | 17.2 | 41.8 | 18.5 | 4.3 |
| 2412-18 | 17.4 | 4.4 | 15.1 | 42.9 | 20.3 | 4.3 |
| 2412-22 | 18.1 | 3.9 | 13.9 | 43.5 | 20.6 | 3.9 |
| 2412-19 | 17.5 | 4.9 | 14.8 | 42.5 | 20.3 | 3.9 |
| 2412-12 | 17.2 | 6.1 | 21.9 | 38.5 | 16.2 | 3.8 |
| 2412-6 | 17.2 | 6.0 | 22.8 | 38.0 | 15.9 | 3.7 |
| 2412-27 | 16.5 | 4.5 | 16.5 | 40.8 | 21.7 | 3.6 |
| Avg. | 16.9 | 5.8 | 20.6 | 40.6 | 16.2 | 4.9 |

TABLE 76

Oil concentrations and fatty acid profiles for events from MSE2413 MSE2413 (PRDGAT2)

| Event | 16:0 | 18:0 | 18:1 | 18:2 | 18:3 | % Oil |
|---|---|---|---|---|---|---|
| 2413-30 | 14.7 | 5.2 | 20.3 | 47.2 | 12.5 | 9.4 |
| 2413-15 | 15.0 | 6.0 | 24.5 | 41.8 | 12.7 | 8.3 |
| 2413-22 | 16.2 | 4.8 | 17.7 | 45.7 | 15.6 | 7.7 |
| 2413-7 | 16.2 | 5.1 | 18.8 | 44.5 | 15.3 | 7.5 |
| 2413-16 | 15.7 | 5.6 | 22.0 | 42.5 | 14.1 | 7.5 |
| 2413-23 | 15.6 | 5.8 | 22.2 | 41.0 | 15.3 | 7.3 |

TABLE 76-continued

Oil concentrations and fatty acid profiles for events from MSE2413 MSE2413 (PRDGAT2)

| Event | 16:0 | 18:0 | 18:1 | 18:2 | 18:3 | % Oil |
|---|---|---|---|---|---|---|
| 2413-11 | 14.9 | 6.0 | 23.5 | 41.7 | 14.0 | 7.2 |
| 2413-31 | 15.6 | 8.7 | 17.9 | 42.9 | 14.8 | 6.1 |
| 2413-28 | 16.6 | 6.3 | 23.8 | 38.2 | 15.0 | 6.1 |
| 2413-21 | 15.8 | 6.4 | 20.0 | 41.5 | 16.3 | 6.0 |
| 2413-27 | 15.7 | 5.7 | 21.7 | 41.3 | 15.7 | 6.0 |
| 2413-4 | 16.4 | 5.0 | 18.2 | 43.5 | 17.0 | 5.8 |
| 2413-19 | 16.0 | 5.4 | 22.5 | 40.3 | 15.8 | 5.7 |
| 2413-18 | 16.1 | 5.7 | 21.0 | 40.0 | 17.2 | 5.5 |
| 2413-14 | 17.2 | 4.6 | 17.6 | 42.6 | 18.0 | 5.5 |
| 2413-13 | 16.7 | 5.5 | 19.7 | 41.5 | 16.6 | 5.4 |
| 2413-24 | 16.6 | 5.9 | 19.6 | 41.3 | 16.5 | 5.3 |
| 2413-25 | 16.8 | 4.9 | 16.4 | 42.5 | 19.3 | 4.9 |
| 2413-2 | 16.6 | 5.3 | 19.8 | 40.8 | 17.6 | 4.7 |
| 2413-6 | 16.4 | 5.3 | 20.0 | 40.0 | 18.2 | 4.7 |
| 2413-26 | 15.8 | 6.4 | 22.8 | 38.5 | 16.5 | 4.6 |
| 2413-20 | 16.0 | 6.4 | 22.2 | 38.5 | 16.8 | 4.6 |
| 2413-29 | 16.1 | 6.1 | 20.9 | 38.0 | 18.9 | 4.4 |
| 2413-17 | 16.8 | 5.5 | 21.1 | 38.0 | 18.5 | 4.3 |
| 2413-10 | 17.4 | 4.7 | 16.9 | 41.5 | 19.5 | 4.1 |
| 2413-8 | 17.2 | 4.8 | 16.2 | 40.9 | 20.9 | 3.9 |
| 2413-5 | 16.3 | 5.2 | 20.3 | 38.9 | 19.4 | 3.9 |
| 2413-3 | 16.1 | 5.5 | 21.8 | 38.0 | 18.6 | 3.8 |
| 2413-1 | 16.7 | 4.8 | 18.1 | 40.3 | 20.1 | 3.7 |
| 2413-12 | 16.8 | 5.0 | 18.7 | 39.8 | 19.8 | 3.5 |
| 2413-9 | 15.2 | 6.0 | 17.3 | 43.1 | 18.4 | 2.6 |
| Avg. | 16.2 | 5.6 | 20.1 | 41.2 | 16.9 | 5.5 |

TABLE 77

Oil concentrations and fatty acid profiles for events from MSE2414 MSE2414 (PR DGAT2cod)

| Event | 16:0 | 18:0 | 18:1 | 18:2 | 18:3 | % Oil |
|---|---|---|---|---|---|---|
| 2414-12 | 15.8 | 4.5 | 18.9 | 46.3 | 14.6 | 8.7 |
| 2414-15 | 15.7 | 4.7 | 19.8 | 45.6 | 14.2 | 8.4 |
| 2414-6 | 14.5 | 4.5 | 25.4 | 40.5 | 15.1 | 8.3 |
| 2414-31 | 17.4 | 5.5 | 22.5 | 39.6 | 15.1 | 6.9 |
| 2414-32 | 15.2 | 4.8 | 26.5 | 39.2 | 14.4 | 6.7 |
| 2414-27 | 14.9 | 5.4 | 26.2 | 39.1 | 14.4 | 6.6 |
| 2414-8 | 15.1 | 4.9 | 27.2 | 38.8 | 14.0 | 6.5 |
| 2414-14 | 16.8 | 5.1 | 18.7 | 43.1 | 16.3 | 6.3 |
| 2414-26 | 15.5 | 4.6 | 24.1 | 40.2 | 15.5 | 6.2 |
| 2414-29 | 14.6 | 5.9 | 23.9 | 38.2 | 17.4 | 6.2 |
| 2414-9 | 15.6 | 4.7 | 26.9 | 38.0 | 14.8 | 6.1 |
| 2414-11 | 15.1 | 5.1 | 26.5 | 38.3 | 15.0 | 6.0 |
| 2414-13 | 14.8 | 5.8 | 32.7 | 34.9 | 11.8 | 6.0 |
| 2414-16 | 16.4 | 5.1 | 22.4 | 40.4 | 15.6 | 5.9 |
| 2414-2 | 17.0 | 4.7 | 23.8 | 38.4 | 16.1 | 5.9 |
| 2414-30 | 15.7 | 4.9 | 24.1 | 40.0 | 15.2 | 5.8 |
| 2414-20 | 15.9 | 5.4 | 23.9 | 39.1 | 15.7 | 5.8 |
| 2414-19 | 16.3 | 4.7 | 20.3 | 40.6 | 18.1 | 5.6 |
| 2414-1 | 16.1 | 4.8 | 21.8 | 40.3 | 17.1 | 5.6 |
| 2414-25 | 15.8 | 5.4 | 22.1 | 39.8 | 16.9 | 5.4 |
| 2414-24 | 15.6 | 6.4 | 24.8 | 35.7 | 17.6 | 5.3 |
| 2414-10 | 17.8 | 5.7 | 21.9 | 38.3 | 16.3 | 4.9 |
| 2414-17 | 16.6 | 4.9 | 22.6 | 38.8 | 17.1 | 4.9 |
| 2414-7 | 17.6 | 5.0 | 16.9 | 40.8 | 19.7 | 4.5 |
| 2414-18 | 16.7 | 5.7 | 18.7 | 39.9 | 19.0 | 4.4 |
| 2414-3 | 16.4 | 5.9 | 22.0 | 38.7 | 17.1 | 4.4 |
| 2414-5 | 16.4 | 3.9 | 14.4 | 42.6 | 22.7 | 4.3 |
| 2414-23 | 18.0 | 5.5 | 20.2 | 38.9 | 17.4 | 4.2 |
| 2414-22 | 16.3 | 5.4 | 21.4 | 38.1 | 18.8 | 4.0 |
| 2414-28 | 17.2 | 4.4 | 16.0 | 41.8 | 20.6 | 3.9 |
| 2414-21 | 17.6 | 5.0 | 18.0 | 40.3 | 19.0 | 3.7 |
| 2414-4 | 17.4 | 4.5 | 15.8 | 40.7 | 21.6 | 3.1 |
| Avg. | 16.2 | 5.1 | 22.2 | 39.8 | 16.7 | 5.6 |

Codon optimization/motif-alteration of LS_DGAT2 resulted in a slight decrease in activity and codon optimization/motif-alteration of PR_DGAT2 did not substantially affect activity when expressed in soy.

Results for pKR1335 (MA_DGAT2; SEQ ID NO:256; Experiment MSE2427), pKR1419 (MA_DGAT2cod; SEQ ID NO:372; Experiment MSE2428), pKR1328 (DH_DGAT2; SEQ ID NO:161; Experiment MSE2429) and pKR1420 (DH_DGAT2cod; SEQ ID NO:366; Experiment MSE2430) are shown in Tables 78, Table 79, Table 80 and Table 81, respectively.

TABLE 78

Oil concentrations and fatty acid profiles for events from MSE2427 MSE2427 (MA DGAT2)

| Event | 16:0 | 18:0 | 18:1 | 18:2 | 18:3 | % Oil |
|---|---|---|---|---|---|---|
| 2427-24 | 13.8 | 6.4 | 30.3 | 38.6 | 10.8 | 9.6 |
| 2427-21 | 13.8 | 6.3 | 32.0 | 36.5 | 11.2 | 8.0 |
| 2427-5 | 14.8 | 5.9 | 25.2 | 41.7 | 12.3 | 7.7 |
| 2427-30 | 16.0 | 5.7 | 21.7 | 41.3 | 15.3 | 7.6 |
| 2427-3 | 15.8 | 6.5 | 24.1 | 40.0 | 13.6 | 7.2 |
| 2427-17 | 14.4 | 6.2 | 30.1 | 36.9 | 12.4 | 7.0 |
| 2427-29 | 16.6 | 6.0 | 19.4 | 41.3 | 16.7 | 6.1 |
| 2427-27 | 16.6 | 5.8 | 18.2 | 42.5 | 16.9 | 6.1 |
| 2427-25 | 15.5 | 7.0 | 24.2 | 38.3 | 15.0 | 5.9 |
| 2427-6 | 16.8 | 5.3 | 18.8 | 42.7 | 16.4 | 5.6 |
| 2427-8 | 16.1 | 6.3 | 19.8 | 40.8 | 17.0 | 5.4 |
| 2427-15 | 16.9 | 5.8 | 20.6 | 39.0 | 17.7 | 4.7 |
| 2427-13 | 16.3 | 5.7 | 19.9 | 40.3 | 17.8 | 4.7 |
| 2427-9 | 15.5 | 5.2 | 21.7 | 38.5 | 19.1 | 4.6 |
| 2427-31 | 15.7 | 6.2 | 17.9 | 41.2 | 19.1 | 4.5 |
| 2427-4 | 15.3 | 5.2 | 20.4 | 39.4 | 19.8 | 4.5 |
| 2427-14 | 14.1 | 5.9 | 18.8 | 43.9 | 17.3 | 4.5 |
| 2427-19 | 15.6 | 6.2 | 22.7 | 37.6 | 17.9 | 4.5 |
| 2427-2 | 17.8 | 5.7 | 17.5 | 39.8 | 19.2 | 4.5 |
| 2427-7 | 17.0 | 5.3 | 17.6 | 41.6 | 18.5 | 4.4 |
| 2427-20 | 16.9 | 5.5 | 18.8 | 39.2 | 19.7 | 4.3 |
| 2427-10 | 16.6 | 5.2 | 17.6 | 40.5 | 20.2 | 4.1 |
| 2427-23 | 17.7 | 5.2 | 15.9 | 40.6 | 20.7 | 4.0 |
| 2427-11 | 15.5 | 5.3 | 23.4 | 39.9 | 15.9 | 4.0 |
| 2427-28 | 16.7 | 5.3 | 16.2 | 40.1 | 21.7 | 3.8 |
| 2427-1 | 16.2 | 5.4 | 17.5 | 40.0 | 20.9 | 3.7 |
| 2427-16 | 17.3 | 5.7 | 18.1 | 39.1 | 19.8 | 3.6 |
| 2427-26 | 16.8 | 5.1 | 16.7 | 40.9 | 20.5 | 3.4 |
| 2427-12 | 16.9 | 4.7 | 13.5 | 40.4 | 24.3 | 3.2 |
| Avg. | 16.0 | 5.7 | 20.6 | 40.1 | 17.5 | 5.2 |

TABLE 79

Oil concentrations and fatty acid profiles for events from MSE2428 MSE2428 (MA DGAT2cod)

| Event | 16:0 | 18:0 | 18:1 | 18:2 | 18:3 | % Oil |
|---|---|---|---|---|---|---|
| 2428-15 | 11.2 | 6.5 | 35.7 | 39.4 | 7.2 | 13.1 |
| 2428-25 | 12.5 | 5.7 | 31.0 | 40.8 | 10.1 | 11.8 |
| 2428-5 | 11.9 | 6.2 | 34.0 | 39.2 | 8.7 | 11.1 |
| 2428-20 | 12.4 | 6.4 | 33.4 | 38.9 | 8.9 | 11.1 |
| 2428-27 | 12.2 | 6.4 | 34.6 | 38.0 | 8.8 | 10.4 |
| 2428-1 | 11.4 | 7.1 | 36.9 | 36.2 | 8.4 | 10.3 |
| 2428-21 | 11.9 | 6.7 | 34.0 | 38.3 | 9.1 | 10.0 |
| 2428-17 | 13.4 | 6.0 | 28.8 | 41.5 | 10.4 | 10.0 |
| 2428-22 | 15.5 | 5.3 | 22.2 | 44.6 | 12.4 | 9.2 |
| 2428-3 | 12.8 | 6.5 | 31.8 | 37.4 | 11.6 | 8.5 |
| 2428-10 | 14.6 | 6.7 | 29.0 | 37.6 | 12.2 | 8.0 |
| 2428-12 | 13.1 | 6.6 | 30.8 | 39.6 | 9.8 | 7.3 |
| 2428-23 | 13.9 | 6.1 | 25.9 | 40.9 | 13.2 | 6.9 |
| 2428-29 | 12.4 | 7.3 | 35.0 | 35.7 | 9.6 | 6.7 |
| 2428-11 | 16.6 | 5.4 | 17.1 | 43.3 | 17.6 | 5.5 |
| 2428-30 | 16.8 | 8.7 | 23.0 | 38.3 | 13.1 | 5.5 |
| 2428-2 | 15.9 | 6.4 | 21.4 | 39.3 | 17.0 | 5.0 |
| 2428-13 | 17.2 | 5.5 | 16.2 | 42.4 | 18.6 | 4.8 |
| 2428-28 | 16.8 | 6.0 | 18.9 | 41.5 | 16.7 | 4.7 |
| 2428-31 | 17.0 | 5.7 | 16.4 | 41.9 | 19.0 | 4.3 |
| 2428-18 | 16.4 | 5.4 | 19.5 | 39.5 | 19.2 | 4.2 |
| 2428-6 | 16.4 | 4.8 | 16.4 | 41.4 | 20.9 | 3.9 |
| 2428-8 | 16.7 | 5.8 | 17.0 | 40.0 | 20.4 | 3.9 |
| 2428-4 | 16.6 | 5.4 | 16.9 | 41.9 | 19.2 | 3.8 |
| 2428-16 | 17.5 | 5.0 | 12.1 | 41.0 | 24.4 | 3.8 |

TABLE 79-continued

Oil concentrations and fatty acid profiles for events from MSE2428 MSE2428 (MA DGAT2cod)

| Event | 16:0 | 18:0 | 18:1 | 18:2 | 18:3 | % Oil |
|---|---|---|---|---|---|---|
| 2428-9 | 17.1 | 5.2 | 14.8 | 40.9 | 21.9 | 3.8 |
| 2428-26 | 16.5 | 5.8 | 17.6 | 38.3 | 21.8 | 3.4 |
| 2428-19 | 16.8 | 4.9 | 13.4 | 39.8 | 25.1 | 3.3 |
| 2428-7 | 14.4 | 6.2 | 13.0 | 43.6 | 22.9 | 3.3 |
| 2428-24 | 17.8 | 5.4 | 18.7 | 39.5 | 18.5 | 2.8 |
| Avg. | 14.9 | 6.0 | 23.9 | 40.0 | 15.2 | 6.7 |

TABLE 80

Oil concentrations and fatty acid profiles for events from MSE2429 MSE2429 (DH DGAT2)

| Event | 16:0 | 18:0 | 18:1 | 18:2 | 18:3 | % Oil |
|---|---|---|---|---|---|---|
| 2429-30 | 16.6 | 5.2 | 17.9 | 44.0 | 16.3 | 6.7 |
| 2429-20 | 16.8 | 4.9 | 16.8 | 43.2 | 18.3 | 5.6 |
| 2429-10 | 15.9 | 5.4 | 19.8 | 41.8 | 17.2 | 5.5 |
| 2429-29 | 17.0 | 5.7 | 18.9 | 41.1 | 17.3 | 5.5 |
| 2429-13 | 16.6 | 5.1 | 18.0 | 42.7 | 17.7 | 5.3 |
| 2429-23 | 16.1 | 5.5 | 19.5 | 41.1 | 17.8 | 5.3 |
| 2429-25 | 16.1 | 5.5 | 19.0 | 41.7 | 17.7 | 5.2 |
| 2429-26 | 16.1 | 5.6 | 18.9 | 40.9 | 18.5 | 5.1 |
| 2429-14 | 16.0 | 5.3 | 19.5 | 41.1 | 18.1 | 4.9 |
| 2429-18 | 15.9 | 6.4 | 21.2 | 39.0 | 17.4 | 4.8 |
| 2429-27 | 16.6 | 5.2 | 18.9 | 41.0 | 18.3 | 4.7 |
| 2429-17 | 16.9 | 4.9 | 17.1 | 42.0 | 19.1 | 4.7 |
| 2429-11 | 15.2 | 4.5 | 17.3 | 43.6 | 19.3 | 4.7 |
| 2429-31 | 16.4 | 5.7 | 19.3 | 40.1 | 18.5 | 4.6 |
| 2429-7 | 16.3 | 5.7 | 19.6 | 39.6 | 18.9 | 4.2 |
| 2429-19 | 16.5 | 5.9 | 20.2 | 37.6 | 19.8 | 4.1 |
| 2429-1 | 16.3 | 4.8 | 15.5 | 41.3 | 22.1 | 4.0 |
| 2429-24 | 16.9 | 5.0 | 17.1 | 39.4 | 21.6 | 4.0 |
| 2429-5 | 16.7 | 5.5 | 19.5 | 39.8 | 18.4 | 3.9 |
| 2429-8 | 16.1 | 6.0 | 20.3 | 39.3 | 18.4 | 3.9 |
| 2429-3 | 17.2 | 5.5 | 18.1 | 40.2 | 19.0 | 3.8 |
| 2429-12 | 16.1 | 5.1 | 18.4 | 40.2 | 20.3 | 3.8 |
| 2429-21 | 16.6 | 5.2 | 15.5 | 40.6 | 22.1 | 3.8 |
| 2429-6 | 16.3 | 5.1 | 17.6 | 40.4 | 20.5 | 3.6 |
| 2429-15 | 17.2 | 4.5 | 12.7 | 42.6 | 23.0 | 3.3 |
| 2429-4 | 15.7 | 5.5 | 16.6 | 40.4 | 21.8 | 3.3 |
| 2429-28 | 13.7 | 5.6 | 14.4 | 44.0 | 22.3 | 3.2 |
| 2429-16 | 16.1 | 4.6 | 15.8 | 39.8 | 23.6 | 3.1 |
| 2429-22 | 14.6 | 4.8 | 11.2 | 43.6 | 25.7 | 3.0 |
| 2429-2 | 16.9 | 4.4 | 13.6 | 41.3 | 23.8 | 2.9 |
| 2429-9 | 16.9 | 5.0 | 16.6 | 38.6 | 22.9 | 2.7 |
| Avg. | 16.3 | 5.3 | 17.6 | 41.0 | 19.9 | 4.3 |

TABLE 81

Oil concentrations and fatty acid profiles for events from MSE2430 MSE2430 (DH DGAT2cod)

| Event | 16:0 | 18:0 | 18:1 | 18:2 | 18:3 | % Oil |
|---|---|---|---|---|---|---|
| 2430-11 | 15.6 | 5.4 | 21.4 | 43.3 | 14.3 | 8.3 |
| 2430-7 | 15.7 | 5.6 | 21.4 | 44.0 | 13.2 | 8.0 |
| 2430-2 | 15.9 | 5.1 | 20.5 | 43.9 | 14.6 | 7.9 |
| 2430-14 | 16.5 | 4.7 | 18.4 | 46.2 | 14.3 | 7.8 |
| 2430-9 | 17.0 | 4.7 | 21.8 | 41.3 | 15.3 | 6.7 |
| 2430-8 | 16.1 | 4.9 | 19.1 | 45.2 | 14.7 | 6.7 |
| 2430-13 | 16.1 | 6.4 | 15.5 | 44.1 | 17.8 | 6.1 |
| 2430-6 | 16.0 | 6.2 | 26.8 | 37.8 | 13.3 | 6.0 |
| 2430-10 | 15.9 | 5.6 | 19.9 | 41.3 | 17.3 | 5.8 |
| 2430-4 | 16.4 | 5.6 | 18.7 | 41.9 | 17.3 | 5.3 |
| 2430-15 | 17.9 | 4.7 | 17.6 | 41.6 | 18.2 | 5.2 |
| 2430-20 | 16.0 | 5.5 | 20.4 | 39.6 | 18.5 | 5.1 |
| 2430-21 | 16.7 | 5.7 | 19.2 | 40.8 | 17.6 | 5.0 |
| 2430-3 | 16.7 | 5.5 | 18.3 | 42.6 | 16.9 | 4.9 |
| 2430-26 | 16.7 | 5.8 | 21.9 | 38.9 | 16.7 | 4.8 |
| 2430-27 | 17.0 | 5.1 | 17.6 | 40.7 | 19.7 | 4.7 |
| 2430-23 | 15.0 | 5.2 | 17.9 | 41.1 | 20.9 | 4.7 |
| 2430-22 | 15.8 | 5.9 | 21.8 | 38.9 | 17.6 | 4.6 |
| 2430-25 | 16.6 | 5.9 | 18.4 | 40.6 | 18.4 | 4.4 |
| 2430-16 | 16.7 | 4.9 | 15.8 | 42.5 | 20.0 | 4.3 |
| 2430-5 | 17.0 | 5.8 | 19.9 | 38.7 | 18.7 | 4.3 |
| 2430-18 | 16.8 | 5.4 | 18.4 | 40.2 | 19.1 | 4.0 |
| 2430-24 | 16.2 | 5.1 | 18.3 | 40.1 | 20.4 | 4.0 |
| 2430-1 | 17.0 | 5.0 | 16.9 | 40.2 | 21.0 | 3.6 |
| 2430-17 | 16.1 | 4.8 | 16.5 | 39.2 | 23.3 | 3.5 |
| 2430-19 | 17.9 | 4.7 | 13.6 | 39.0 | 24.9 | 3.3 |
| 2430-12 | 18.5 | 5.1 | 21.0 | 36.8 | 18.6 | 2.9 |
| Avg. | 16.5 | 5.3 | 19.1 | 41.1 | 17.9 | 5.3 |

Codon optimization/motif alteration of MA_DGAT2 and DH_DGAT2 substantially increased activity when expressed in soy.

Results for pKR1332 (PA_DGAT2; SEQ ID NO:260; Experiment MSE2431), pKR1421 (PA_DGAT2cod; SEQ ID NO:365; Experiment MSE2432), pKR1324 (TD_DGAT2A; SEQ ID NO:121; Experiment MSE2433) and pKR1422 (TD_DGAT2Acod; SEQ ID NO:364; Experiment MSE2434) are shown in Tables 82, Table 83, Table 84 and Table 85, respectively.

TABLE 82

Oil concentrations and fatty acid profiles for events from MSE2431 MSE2431 (PA DGAT2)

| Event | 16:0 | 18:0 | 18:1 | 18:2 | 18:3 | % Oil |
|---|---|---|---|---|---|---|
| 2431-28 | 16.4 | 6.2 | 26.2 | 38.7 | 12.5 | 8.5 |
| 2431-21 | 16.2 | 4.4 | 20.4 | 45.0 | 14.0 | 8.0 |
| 2431-19 | 15.3 | 4.9 | 20.3 | 43.7 | 15.8 | 7.9 |
| 2431-23 | 14.5 | 6.0 | 22.8 | 41.1 | 15.6 | 7.5 |
| 2431-22 | 15.9 | 7.8 | 28.1 | 35.1 | 13.0 | 7.1 |
| 2431-6 | 15.4 | 6.0 | 24.2 | 38.7 | 15.6 | 6.8 |
| 2431-25 | 16.8 | 5.0 | 22.7 | 40.5 | 15.0 | 6.5 |
| 2431-24 | 16.6 | 5.6 | 18.9 | 42.8 | 16.1 | 6.3 |
| 2431-7 | 16.3 | 4.4 | 15.8 | 45.1 | 18.3 | 6.1 |
| 2431-30 | 15.6 | 5.6 | 22.1 | 39.8 | 16.8 | 5.9 |
| 2431-31 | 16.2 | 5.1 | 18.4 | 41.0 | 19.3 | 5.8 |
| 2431-11 | 16.2 | 5.8 | 18.9 | 42.2 | 16.9 | 5.7 |
| 2431-26 | 15.7 | 5.5 | 22.2 | 39.5 | 17.1 | 5.7 |
| 2431-1 | 16.6 | 5.2 | 19.5 | 42.2 | 16.4 | 5.6 |
| 2431-2 | 15.9 | 5.1 | 18.8 | 41.1 | 19.2 | 5.5 |
| 2431-10 | 15.4 | 4.7 | 20.8 | 41.1 | 18.0 | 5.5 |
| 2431-5 | 15.8 | 4.7 | 19.4 | 41.1 | 19.1 | 5.5 |
| 2431-27 | 16.8 | 4.9 | 17.7 | 42.3 | 18.2 | 5.5 |
| 2431-9 | 17.0 | 5.7 | 16.7 | 38.8 | 21.8 | 5.0 |
| 2431-20 | 17.0 | 5.1 | 18.4 | 41.8 | 17.7 | 4.7 |
| 2431-14 | 17.3 | 4.4 | 11.5 | 45.2 | 21.5 | 4.7 |
| 2431-17 | 18.0 | 4.3 | 13.2 | 42.6 | 22.0 | 4.5 |
| 2431-4 | 16.6 | 5.4 | 20.6 | 38.0 | 19.4 | 4.5 |
| 2431-15 | 15.2 | 5.3 | 21.3 | 39.7 | 18.6 | 4.4 |
| 2431-29 | 17.2 | 5.1 | 18.2 | 41.1 | 18.3 | 4.3 |
| 2431-18 | 16.4 | 5.1 | 21.0 | 39.8 | 17.6 | 4.3 |
| 2431-13 | 17.4 | 5.3 | 19.2 | 38.0 | 20.1 | 4.3 |
| 2431-12 | 18.3 | 4.4 | 15.5 | 40.3 | 21.6 | 4.2 |
| 2431-16 | 18.0 | 5.1 | 16.5 | 38.9 | 21.6 | 4.2 |
| 2431-8 | 15.4 | 4.8 | 20.7 | 39.2 | 19.9 | 4.0 |
| 2431-3 | 15.9 | 5.3 | 21.7 | 39.9 | 17.2 | 2.9 |
| Avg. | 16.4 | 5.2 | 19.7 | 40.8 | 17.9 | 5.5 |

TABLE 83

Oil concentrations and fatty acid profiles for events from MSE2432 MSE2432 (PA DGAT2cod)

| Event | 16:0 | 18:0 | 18:1 | 18:2 | 18:3 | % Oil |
|---|---|---|---|---|---|---|
| 2432-13 | 12.3 | 4.8 | 37.3 | 39.6 | 5.9 | 20.8 |
| 2432-6 | 13.2 | 4.3 | 29.8 | 44.0 | 8.7 | 17.4 |
| 2432-11 | 12.3 | 5.2 | 38.8 | 37.3 | 6.3 | 17.0 |
| 2432-16 | 12.4 | 5.8 | 42.9 | 33.1 | 5.8 | 16.0 |
| 2432-27 | 13.8 | 4.3 | 36.6 | 37.2 | 8.1 | 14.1 |
| 2432-21 | 14.1 | 4.7 | 26.6 | 44.3 | 10.2 | 13.9 |
| 2432-23 | 15.5 | 4.2 | 19.6 | 50.0 | 10.6 | 13.7 |
| 2432-5 | 15.2 | 4.8 | 27.3 | 42.1 | 10.5 | 13.4 |
| 2432-8 | 15.6 | 4.5 | 24.5 | 45.6 | 9.9 | 13.3 |
| 2432-15 | 12.2 | 6.2 | 44.0 | 31.1 | 6.5 | 13.2 |
| 2432-9 | 16.7 | 4.5 | 21.3 | 46.2 | 11.2 | 12.3 |
| 2432-4 | 15.8 | 4.4 | 22.0 | 46.5 | 11.4 | 12.1 |
| 2432-17 | 15.4 | 4.6 | 19.9 | 48.0 | 12.2 | 11.9 |
| 2432-12 | 15.2 | 4.8 | 22.7 | 45.7 | 11.6 | 11.3 |
| 2432-26 | 16.3 | 5.2 | 21.5 | 46.5 | 10.5 | 11.1 |
| 2432-25 | 14.0 | 6.5 | 30.0 | 39.9 | 9.7 | 11.0 |
| 2432-7 | 15.7 | 4.8 | 25.2 | 43.4 | 10.9 | 10.6 |
| 2432-3 | 14.8 | 5.1 | 24.7 | 44.2 | 11.2 | 10.4 |
| 2432-28 | 15.0 | 4.7 | 23.0 | 45.7 | 11.7 | 10.4 |
| 2432-29 | 15.5 | 5.4 | 21.9 | 45.0 | 12.3 | 9.7 |
| 2432-10 | 14.6 | 5.4 | 30.2 | 39.2 | 10.5 | 9.6 |
| 2432-18 | 16.2 | 5.1 | 21.0 | 44.0 | 13.7 | 8.4 |
| 2432-1 | 15.6 | 5.2 | 18.5 | 46.3 | 14.3 | 7.8 |
| 2432-30 | 15.2 | 4.5 | 22.7 | 43.6 | 13.9 | 7.6 |
| 2432-22 | 16.4 | 4.3 | 15.0 | 45.6 | 18.6 | 7.2 |
| 2432-31 | 15.9 | 4.4 | 17.9 | 45.4 | 16.4 | 7.1 |
| 2432-2 | 15.7 | 4.8 | 22.9 | 42.4 | 14.2 | 7.1 |
| 2432-20 | 16.0 | 4.5 | 28.5 | 36.6 | 14.5 | 6.9 |
| 2432-14 | 15.4 | 5.1 | 20.9 | 41.2 | 17.5 | 6.8 |
| 2432-19 | 17.4 | 4.9 | 14.7 | 42.7 | 20.3 | 5.3 |
| 2432-24 | 17.2 | 3.7 | 11.5 | 46.7 | 20.9 | 5.1 |
| Avg. | 15.1 | 4.9 | 25.3 | 42.9 | 11.9 | 11.1 |

TABLE 84

Oil concentrations and fatty acid profiles for events from MSE2433 MSE2433 (TD DGAT2A)

| Event | 16:0 | 18:0 | 18:1 | 18:2 | 18:3 | % Oil |
|---|---|---|---|---|---|---|
| 2433-45 | 15.7 | 4.0 | 20.3 | 50.4 | 9.7 | 16.0 |
| 2433-16 | 15.5 | 4.5 | 21.3 | 49.5 | 9.3 | 15.0 |
| 2433-19 | 14.5 | 4.7 | 22.8 | 48.3 | 9.7 | 14.9 |
| 2433-25 | 15.2 | 4.1 | 20.5 | 50.3 | 9.9 | 14.6 |
| 2433-29 | 13.8 | 5.1 | 23.8 | 47.3 | 10.1 | 14.3 |
| 2433-21 | 15.0 | 4.8 | 22.1 | 48.0 | 10.1 | 14.0 |
| 2433-30 | 14.1 | 4.1 | 20.4 | 50.1 | 11.3 | 12.8 |
| 2433-38 | 16.0 | 3.5 | 16.9 | 52.2 | 11.4 | 12.8 |
| 2433-39 | 14.5 | 5.7 | 22.8 | 46.5 | 10.5 | 12.7 |
| 2433-42 | 14.6 | 5.4 | 23.2 | 46.2 | 10.5 | 11.8 |
| 2433-34 | 14.0 | 4.6 | 20.3 | 49.3 | 11.8 | 11.7 |
| 2433-26 | 13.8 | 5.1 | 21.6 | 48.1 | 11.4 | 11.6 |
| 2433-5 | 14.2 | 5.9 | 24.8 | 44.3 | 10.8 | 11.3 |
| 2433-11 | 15.5 | 5.0 | 21.6 | 46.8 | 11.2 | 10.9 |
| 2433-1 | 15.3 | 4.9 | 21.9 | 46.7 | 11.2 | 10.9 |
| 2433-15 | 14.0 | 6.3 | 26.6 | 42.3 | 10.8 | 10.6 |
| 2433-13 | 14.7 | 5.5 | 23.4 | 44.1 | 12.2 | 10.2 |
| 2433-3 | 15.2 | 5.2 | 23.4 | 45.1 | 11.1 | 10.1 |
| 2433-6 | 15.1 | 5.6 | 23.2 | 44.2 | 12.0 | 10.1 |
| 2433-24 | 16.1 | 4.3 | 19.0 | 47.1 | 13.5 | 9.6 |
| 2433-23 | 15.9 | 4.0 | 18.0 | 47.7 | 14.4 | 9.6 |
| 2433-43 | 14.9 | 5.5 | 22.5 | 44.7 | 12.5 | 9.5 |
| 2433-2 | 16.3 | 4.4 | 17.1 | 48.0 | 14.2 | 9.3 |
| 2433-4 | 14.2 | 6.1 | 23.4 | 46.0 | 12.4 | 9.0 |
| 2433-17 | 15.5 | 5.2 | 21.4 | 44.4 | 13.4 | 8.8 |
| 2433-7 | 15.8 | 4.8 | 18.7 | 46.7 | 14.0 | 8.8 |
| 2433-10 | 15.7 | 5.6 | 23.1 | 42.9 | 12.7 | 8.2 |
| 2433-14 | 16.4 | 4.8 | 18.9 | 46.0 | 13.9 | 8.1 |
| 2433-8 | 16.3 | 5.3 | 19.4 | 44.5 | 14.4 | 7.8 |
| 2433-12 | 16.0 | 6.3 | 22.3 | 42.6 | 12.8 | 7.1 |
| 2433-9 | 17.4 | 4.3 | 15.0 | 44.7 | 18.5 | 5.3 |
| Avg. | 15.2 | 5.0 | 21.3 | 46.5 | 12.0 | 10.9 |

TABLE 85

Oil concentrations and fatty acid profiles for events from MSE2434 MSE2434 (TD DGAT2Acod)

| Event | 16:0 | 18:0 | 18:1 | 18:2 | 18:3 | % Oil |
|---|---|---|---|---|---|---|
| 2434-3 | 14.9 | 4.6 | 26.4 | 43.7 | 10.4 | 12.7 |
| 2434-12 | 15.0 | 5.1 | 22.3 | 45.5 | 12.1 | 11.1 |
| 2434-7 | 14.8 | 5.3 | 26.6 | 41.1 | 12.3 | 10.9 |
| 2434-20 | 13.9 | 6.2 | 23.8 | 43.9 | 12.3 | 10.3 |
| 2434-6 | 15.2 | 3.8 | 18.7 | 46.5 | 15.9 | 9.6 |
| 2434-16 | 14.7 | 5.0 | 22.6 | 44.0 | 13.8 | 9.6 |
| 2434-5 | 15.5 | 5.1 | 22.3 | 43.9 | 13.2 | 9.5 |
| 2434-24 | 14.8 | 6.4 | 25.9 | 40.9 | 12.1 | 9.4 |
| 2434-15 | 15.4 | 5.6 | 22.1 | 43.5 | 13.4 | 9.0 |
| 2434-9 | 13.4 | 4.3 | 18.3 | 47.0 | 17.0 | 8.8 |
| 2434-18 | 15.3 | 5.6 | 24.5 | 41.0 | 13.6 | 8.7 |
| 2434-13 | 15.7 | 5.0 | 18.5 | 46.9 | 13.8 | 8.6 |
| 2434-14 | 15.4 | 5.2 | 19.7 | 44.7 | 15.1 | 8.6 |
| 2434-10 | 14.7 | 6.8 | 24.3 | 39.5 | 14.8 | 8.5 |
| 2434-1 | 15.2 | 5.0 | 19.4 | 44.4 | 16.0 | 8.4 |
| 2434-28 | 14.5 | 6.1 | 24.8 | 40.9 | 13.6 | 8.2 |
| 2434-11 | 14.0 | 6.6 | 27.6 | 38.8 | 13.0 | 8.2 |
| 2434-8 | 15.4 | 5.7 | 22.0 | 42.4 | 14.4 | 8.0 |
| 2434-23 | 15.6 | 4.8 | 19.3 | 44.6 | 15.7 | 7.9 |
| 2434-27 | 15.4 | 5.2 | 23.4 | 40.9 | 15.1 | 7.8 |
| 2434-17 | 15.7 | 5.6 | 24.5 | 39.4 | 14.8 | 7.5 |
| 2434-25 | 15.5 | 5.0 | 20.6 | 41.4 | 17.4 | 7.0 |
| 2434-2 | 15.5 | 4.8 | 18.9 | 44.1 | 16.7 | 6.9 |
| 2434-4 | 16.7 | 4.3 | 18.3 | 46.3 | 14.5 | 6.8 |
| 2434-21 | 15.9 | 4.0 | 15.9 | 45.4 | 19.0 | 6.8 |
| 2434-31 | 15.5 | 4.5 | 19.4 | 42.1 | 18.6 | 6.7 |
| 2434-29 | 16.3 | 4.4 | 18.5 | 43.7 | 17.1 | 6.5 |
| 2434-26 | 16.1 | 5.1 | 18.7 | 40.1 | 20.0 | 5.9 |
| 2434-30 | 16.8 | 4.8 | 17.2 | 42.4 | 18.8 | 5.8 |
| 2434-22 | 16.7 | 4.1 | 15.1 | 46.0 | 18.1 | 5.7 |
| 2434-19 | 16.1 | 8.1 | 23.5 | 38.2 | 14.1 | 5.7 |
| Avg. | 15.3 | 5.2 | 21.4 | 43.0 | 15.1 | 8.2 |

Codon optimization/motif-alteration of PA_DGAT2 resulted in very large increase in activity and codon optimization/motif-alteration of TD_DGAT2A decreased activity when expressed in soy.

Results for pKR1333 (RG_DGAT2; SEQ ID NO:266; Experiment MSE2447) and pKR1423 (RG -DGAT2cod; SEQ ID NO:371; Experiment MSE2448) are shown in Tables 86 and Table 87, respectively.

TABLE 86

Oil concentrations and fatty acid profiles for events from MSE2447 MSE2447 (RG DGAT2)

| Event | 16:0 | 18:0 | 18:1 | 18:2 | 18:3 | % Oil |
|---|---|---|---|---|---|---|
| 2447-27 | 16.8 | 6.3 | 31.2 | 34.2 | 11.5 | 6.4 |
| 2447-18 | 16.4 | 4.3 | 22.2 | 41.4 | 15.7 | 6.1 |
| 2447-17 | 16.8 | 5.9 | 27.5 | 35.6 | 14.2 | 5.7 |
| 2447-28 | 17.1 | 4.8 | 24.0 | 38.2 | 15.9 | 5.3 |
| 2447-10 | 17.5 | 5.9 | 25.8 | 37.2 | 13.7 | 5.2 |
| 2447-13 | 16.6 | 5.1 | 23.1 | 38.3 | 16.9 | 5.2 |
| 2447-7 | 17.2 | 4.9 | 21.1 | 39.4 | 17.3 | 4.9 |
| 2447-11 | 16.7 | 5.2 | 21.9 | 39.0 | 17.2 | 4.8 |
| 2447-21 | 14.2 | 5.6 | 21.0 | 40.3 | 18.9 | 4.6 |
| 2447-24 | 17.6 | 5.2 | 22.9 | 37.7 | 16.6 | 4.6 |
| 2447-6 | 16.8 | 5.0 | 17.0 | 41.3 | 19.9 | 4.4 |
| 2447-14 | 17.2 | 4.4 | 16.3 | 40.1 | 22.0 | 4.4 |

TABLE 86-continued

Oil concentrations and fatty acid profiles for events from MSE2447 MSE2447 (RG DGAT2)

| Event | 16:0 | 18:0 | 18:1 | 18:2 | 18:3 | % Oil |
|---|---|---|---|---|---|---|
| 2447-25 | 17.2 | 5.2 | 19.6 | 39.7 | 18.4 | 4.4 |
| 2447-9 | 16.9 | 4.4 | 20.8 | 38.8 | 19.1 | 4.3 |
| 2447-8 | 16.7 | 5.4 | 24.4 | 36.1 | 17.4 | 4.2 |
| 2447-26 | 17.1 | 4.4 | 17.0 | 40.0 | 21.4 | 4.1 |
| 2447-23 | 16.5 | 5.1 | 22.0 | 39.1 | 17.4 | 4.0 |
| 2447-16 | 16.4 | 4.8 | 20.4 | 38.1 | 20.2 | 3.9 |
| 2447-19 | 16.7 | 4.6 | 19.3 | 39.2 | 20.3 | 3.9 |
| 2447-30 | 17.3 | 4.6 | 15.3 | 39.3 | 23.5 | 3.8 |
| 2447-4 | 16.3 | 5.0 | 22.2 | 36.6 | 19.8 | 3.7 |
| 2447-3 | 17.3 | 4.5 | 18.0 | 39.1 | 21.1 | 3.6 |
| 2447-22 | 18.0 | 4.4 | 13.2 | 42.1 | 22.3 | 3.5 |
| 2447-15 | 19.5 | 5.2 | 21.8 | 32.8 | 20.6 | 3.3 |
| 2447-20 | 17.9 | 5.0 | 15.6 | 40.0 | 21.6 | 3.1 |
| 2447-31 | 17.5 | 4.7 | 16.2 | 39.8 | 21.9 | 3.0 |
| 2447-12 | 17.4 | 4.9 | 15.9 | 38.9 | 22.8 | 2.7 |
| Avg. | 17.0 | 5.0 | 20.6 | 38.6 | 18.8 | 4.3 |

TABLE 87

Oil concentrations and fatty acid profiles for events from MSE2448 MSE2448 (RG DGAT2cod)

| Event | 16:0 | 18:0 | 18:1 | 18:2 | 18:3 | % Oil |
|---|---|---|---|---|---|---|
| 2448-6 | 16.0 | 6.1 | 31.7 | 33.5 | 12.7 | 6.7 |
| 2448-4 | 16.7 | 5.3 | 26.6 | 37.6 | 13.8 | 6.5 |
| 2448-5 | 16.1 | 5.2 | 28.2 | 36.7 | 13.8 | 6.0 |
| 2448-22 | 16.5 | 5.4 | 25.6 | 35.9 | 16.5 | 5.4 |
| 2448-17 | 15.8 | 5.9 | 29.4 | 35.1 | 13.9 | 5.2 |
| 2448-20 | 16.3 | 5.7 | 27.4 | 35.2 | 15.4 | 5.2 |
| 2448-16 | 17.4 | 4.6 | 17.9 | 42.8 | 17.3 | 5.0 |
| 2448-28 | 16.6 | 4.2 | 19.1 | 40.6 | 19.4 | 4.7 |
| 2448-13 | 17.2 | 4.9 | 24.1 | 37.1 | 16.7 | 4.7 |
| 2448-30 | 17.7 | 3.6 | 14.2 | 43.3 | 21.2 | 4.2 |
| 2448-2 | 17.3 | 5.2 | 21.9 | 38.0 | 17.6 | 3.9 |
| 2448-24 | 16.8 | 4.3 | 16.0 | 38.9 | 23.9 | 3.7 |
| 2448-11 | 17.8 | 4.7 | 14.2 | 40.8 | 22.5 | 3.6 |
| 2448-18 | 16.3 | 4.3 | 13.3 | 39.8 | 26.3 | 3.6 |
| 2448-29 | 17.1 | 4.9 | 19.1 | 37.8 | 21.1 | 3.5 |
| 2448-12 | 17.1 | 5.2 | 15.0 | 40.7 | 22.0 | 3.5 |
| 2448-3 | 16.3 | 4.5 | 14.8 | 39.1 | 25.3 | 3.5 |
| 2448-9 | 17.0 | 4.8 | 17.8 | 38.2 | 22.3 | 3.4 |
| 2448-25 | 17.9 | 4.1 | 17.1 | 40.2 | 20.6 | 3.3 |
| 2448-23 | 16.9 | 4.2 | 15.5 | 40.8 | 22.6 | 3.2 |
| 2448-14 | 16.8 | 6.0 | 17.4 | 38.3 | 21.5 | 3.0 |
| 2448-7 | 17.1 | 4.4 | 14.2 | 41.1 | 23.2 | 3.0 |
| 2448-19 | 16.7 | 4.0 | 13.5 | 42.5 | 23.3 | 2.9 |
| 2448-21 | 16.6 | 3.8 | 13.5 | 39.9 | 26.2 | 2.8 |
| 2448-1 | 16.8 | 4.5 | 16.5 | 38.4 | 23.8 | 2.2 |
| 2448-15 | 17.4 | 4.7 | 18.4 | 39.8 | 19.7 | 2.2 |
| Avg. | 16.9 | 4.8 | 19.3 | 38.9 | 20.1 | 4.0 |

Codon optimization/motif-alteration of RG_DGAT2 did not substantially affect activity when expressed in soy.

Results for pKR1375 (LS_DGAT1; SEQ ID NO:300; Experiment MSE2510), pKR1514 (LS_DGAT1 cod; SEQ ID NO:374; Experiment MSE2511), pKR1334 (MA_DGAT1; SEQ ID NO:280; Experiment MSE2512) and pKR1419 (MA_DGAT2cod; SEQ ID NO:372; Experiment MSE2513) are shown in Tables 88, Table 89, Table 90 and Table 91, respectively.

TABLE 88

Oil concentrations and fatty acid profiles for events from MSE2510 MSE2510 (LS DGAT1)

| Event | 16:0 | 18:0 | 18:1 | 18:2 | 18:3 | % Oil |
|---|---|---|---|---|---|---|
| 2510-14 | 15.1 | 6.4 | 30.1 | 38.4 | 10.0 | 9.8 |
| 2510-27 | 15.3 | 6.1 | 27.3 | 39.8 | 11.6 | 9.0 |
| 2510-13 | 15.6 | 6.8 | 27.7 | 37.7 | 12.1 | 8.4 |
| 2510-25 | 18.5 | 6.6 | 24.7 | 37.0 | 13.1 | 8.0 |
| 2510-11 | 15.9 | 6.5 | 27.2 | 36.8 | 13.6 | 7.1 |
| 2510-4 | 16.3 | 5.3 | 25.3 | 37.5 | 15.6 | 7.1 |
| 2510-23 | 16.2 | 5.9 | 23.9 | 38.9 | 15.1 | 6.4 |
| 2510-2 | 16.5 | 5.9 | 21.2 | 39.8 | 16.5 | 6.3 |
| 2510-15 | 17.0 | 5.5 | 19.0 | 43.3 | 15.2 | 6.2 |
| 2510-6 | 18.7 | 5.6 | 22.7 | 39.1 | 13.9 | 6.0 |
| 2510-19 | 15.5 | 6.0 | 22.0 | 40.2 | 16.3 | 5.9 |
| 2510-22 | 16.6 | 6.8 | 19.4 | 41.5 | 15.6 | 5.9 |
| 2510-9 | 16.5 | 5.6 | 21.3 | 39.8 | 16.8 | 5.9 |
| 2510-28 | 16.7 | 5.6 | 20.0 | 40.6 | 17.0 | 5.7 |
| 2510-20 | 17.0 | 5.8 | 20.9 | 41.0 | 15.3 | 5.6 |
| 2510-8 | 16.9 | 5.9 | 20.3 | 40.6 | 16.3 | 5.2 |
| 2510-12 | 17.1 | 5.7 | 20.7 | 38.9 | 17.6 | 5.2 |
| 2510-24 | 16.9 | 6.5 | 24.0 | 37.8 | 14.7 | 5.2 |
| 2510-16 | 17.0 | 6.2 | 22.5 | 37.4 | 16.9 | 4.9 |
| 2510-31 | 16.9 | 5.9 | 19.9 | 40.1 | 17.3 | 4.8 |
| 2510-17 | 17.4 | 5.3 | 20.8 | 38.6 | 17.9 | 4.5 |
| 2510-21 | 16.8 | 5.1 | 18.0 | 40.9 | 19.2 | 4.4 |
| 2510-18 | 17.5 | 5.1 | 17.9 | 39.8 | 19.7 | 4.3 |
| 2510-10 | 16.2 | 4.8 | 17.0 | 42.8 | 19.2 | 4.2 |
| 2510-30 | 17.3 | 4.9 | 16.5 | 41.3 | 19.9 | 4.2 |
| 2510-26 | 17.7 | 5.2 | 20.4 | 38.2 | 18.5 | 4.1 |
| 2510-5 | 17.8 | 4.4 | 13.9 | 41.7 | 22.1 | 3.9 |
| 2510-1 | 16.8 | 4.8 | 17.2 | 40.1 | 21.2 | 3.9 |
| 2510-7 | 17.4 | 5.6 | 18.2 | 39.6 | 19.3 | 3.5 |
| 2510-3 | 18.2 | 4.5 | 14.1 | 40.7 | 22.5 | 3.1 |
| 2510-29 | 17.1 | 4.3 | 13.2 | 40.3 | 25.1 | 2.5 |
| Avg. | 16.8 | 5.6 | 20.9 | 39.7 | 16.9 | 5.5 |

TABLE 89

Oil concentrations and fatty acid profiles for events from MSE2511 MSE2511 (LS DGAT1cod)

| Event | 16:0 | 18:0 | 18:1 | 18:2 | 18:3 | % Oil |
|---|---|---|---|---|---|---|
| 2511-19 | 14.6 | 6.8 | 31.3 | 38.6 | 8.7 | 12.2 |
| 2511-18 | 16.0 | 8.2 | 30.7 | 36.7 | 8.4 | 11.9 |
| 2511-29 | 15.0 | 6.4 | 29.1 | 37.9 | 11.6 | 9.2 |
| 2511-6 | 15.9 | 5.7 | 24.8 | 40.8 | 12.6 | 8.0 |
| 2511-8 | 17.6 | 6.5 | 25.3 | 38.6 | 12.0 | 7.9 |
| 2511-21 | 17.1 | 4.7 | 16.6 | 45.9 | 15.6 | 7.0 |
| 2511-2 | 15.9 | 6.5 | 24.5 | 39.0 | 14.1 | 6.9 |
| 2511-27 | 16.9 | 5.9 | 22.1 | 39.9 | 15.2 | 6.5 |
| 2511-12 | 15.8 | 6.5 | 22.9 | 39.0 | 15.7 | 6.4 |
| 2511-23 | 15.7 | 6.8 | 29.6 | 36.6 | 11.3 | 6.4 |
| 2511-20 | 16.8 | 6.0 | 20.5 | 40.4 | 16.3 | 6.3 |
| 2511-5 | 15.8 | 5.8 | 24.7 | 37.7 | 16.0 | 6.1 |
| 2511-30 | 16.5 | 6.7 | 23.8 | 39.3 | 13.6 | 5.6 |
| 2511-13 | 17.3 | 5.4 | 20.1 | 39.4 | 17.8 | 5.4 |
| 2511-4 | 16.9 | 6.1 | 21.7 | 39.3 | 15.9 | 5.2 |
| 2511-15 | 16.9 | 5.4 | 20.6 | 40.2 | 17.0 | 5.0 |
| 2511-10 | 16.9 | 5.5 | 20.9 | 39.1 | 17.7 | 4.9 |
| 2511-25 | 17.2 | 5.9 | 20.7 | 38.1 | 18.1 | 4.8 |
| 2511-3 | 16.7 | 5.7 | 19.6 | 40.5 | 17.5 | 4.8 |
| 2511-17 | 17.3 | 5.2 | 19.1 | 40.0 | 18.3 | 4.7 |
| 2511-7 | 17.3 | 5.4 | 19.7 | 40.7 | 16.8 | 4.5 |
| 2511-14 | 17.2 | 5.9 | 19.2 | 40.4 | 17.3 | 4.3 |
| 2511-26 | 17.6 | 5.3 | 17.2 | 39.6 | 20.3 | 4.2 |
| 2511-9 | 17.5 | 5.3 | 17.8 | 40.3 | 19.0 | 4.1 |
| 2511-22 | 17.2 | 6.7 | 23.6 | 36.8 | 15.7 | 3.7 |
| 2511-16 | 17.3 | 5.5 | 16.0 | 41.1 | 20.0 | 3.7 |
| 2511-24 | 17.3 | 5.3 | 17.2 | 40.3 | 20.0 | 3.7 |
| 2511-28 | 17.4 | 4.9 | 14.3 | 43.5 | 20.0 | 3.7 |
| 2511-1 | 17.1 | 5.4 | 18.6 | 40.2 | 18.7 | 3.6 |
| 2511-31 | 15.9 | 4.8 | 15.4 | 39.8 | 24.1 | 2.9 |
| 2511-11 | 16.7 | 4.2 | 14.1 | 41.7 | 23.4 | 2.9 |
| Avg. | 16.7 | 5.8 | 21.3 | 39.7 | 16.4 | 5.7 |

TABLE 90

Oil concentrations and fatty acid profiles for events from MSE2512 MSE2512 (MA DGAT1)

| Event | 16:0 | 18:0 | 18:1 | 18:2 | 18:3 | % Oil |
|---|---|---|---|---|---|---|
| 2512-27 | 11.1 | 6.2 | 42.7 | 34.0 | 6.1 | 13.6 |
| 2512-5 | 12.0 | 6.6 | 35.4 | 37.9 | 8.1 | 13.5 |
| 2512-2 | 12.9 | 8.2 | 35.3 | 36.5 | 7.1 | 12.4 |
| 2512-24 | 12.7 | 6.6 | 35.5 | 37.2 | 8.0 | 11.6 |
| 2512-14 | 13.5 | 6.2 | 32.4 | 38.4 | 9.6 | 11.3 |
| 2512-1 | 14.6 | 6.5 | 30.8 | 38.4 | 9.6 | 11.0 |
| 2512-4 | 13.0 | 7.2 | 37.2 | 34.5 | 8.1 | 11.0 |
| 2512-15 | 13.5 | 5.7 | 32.5 | 37.7 | 10.6 | 10.2 |
| 2512-8 | 12.6 | 6.2 | 36.7 | 36.0 | 8.5 | 10.1 |
| 2512-25 | 13.8 | 5.9 | 31.1 | 37.5 | 11.7 | 8.9 |
| 2512-3 | 16.1 | 5.7 | 24.7 | 39.2 | 14.3 | 6.6 |
| 2512-9 | 16.2 | 5.9 | 20.3 | 42.0 | 15.6 | 6.5 |
| 2512-19 | 16.4 | 5.9 | 23.1 | 39.5 | 15.2 | 6.1 |
| 2512-7 | 16.5 | 6.4 | 23.1 | 38.7 | 15.3 | 6.0 |
| 2512-11 | 16.1 | 5.5 | 21.5 | 40.0 | 16.9 | 5.9 |
| 2512-18 | 16.3 | 5.9 | 20.1 | 41.3 | 16.4 | 5.6 |
| 2512-30 | 17.4 | 4.8 | 16.7 | 42.7 | 18.4 | 5.4 |
| 2512-10 | 17.0 | 5.2 | 18.1 | 42.0 | 17.6 | 5.4 |
| 2512-21 | 17.0 | 5.2 | 18.1 | 41.9 | 17.9 | 5.3 |
| 2512-13 | 17.0 | 4.5 | 18.2 | 40.6 | 19.7 | 5.1 |
| 2512-31 | 16.7 | 5.2 | 19.4 | 41.3 | 17.4 | 4.9 |
| 2512-12 | 17.8 | 4.6 | 17.7 | 43.2 | 16.6 | 4.8 |
| 2512-26 | 17.7 | 4.8 | 16.9 | 42.4 | 18.3 | 4.8 |
| 2512-22 | 17.3 | 4.4 | 15.2 | 40.9 | 22.1 | 4.6 |
| 2512-17 | 16.9 | 5.4 | 18.1 | 39.5 | 20.1 | 4.5 |
| 2512-20 | 17.2 | 5.5 | 20.1 | 38.5 | 18.8 | 4.0 |
| 2512-16 | 16.4 | 4.5 | 17.5 | 40.3 | 21.2 | 4.0 |
| 2512-29 | 16.8 | 4.4 | 15.5 | 40.4 | 22.8 | 3.8 |
| 2512-23 | 17.9 | 5.1 | 15.5 | 40.6 | 20.9 | 3.1 |
| 2512-28 | 17.3 | 6.1 | 20.4 | 38.8 | 17.3 | 2.6 |
| Avg. | 15.6 | 5.7 | 24.3 | 39.4 | 15.0 | 7.1 |

TABLE 91

Oil concentrations and fatty acid profiles for events from MSE2513 MSE22513 (MA DGAT1cod)

| Event | 16:0 | 18:0 | 18:1 | 18:2 | 18:3 | % Oil |
|---|---|---|---|---|---|---|
| 2513-18 | 11.9 | 6.2 | 36.9 | 38.8 | 6.2 | 17.6 |
| 2513-14 | 10.5 | 6.9 | 40.7 | 35.9 | 6.0 | 16.7 |
| 2513-12 | 11.2 | 7.3 | 41.4 | 34.3 | 5.8 | 15.0 |
| 2513-22 | 11.0 | 5.0 | 38.8 | 37.7 | 7.5 | 14.7 |
| 2513-31 | 12.2 | 6.4 | 36.2 | 37.8 | 7.4 | 13.5 |
| 2513-20 | 11.7 | 6.4 | 36.4 | 38.3 | 7.3 | 13.1 |
| 2513-19 | 12.6 | 5.1 | 33.6 | 39.4 | 9.2 | 13.0 |
| 2513-5 | 12.7 | 6.6 | 34.9 | 37.4 | 8.3 | 12.2 |
| 2513-13 | 14.7 | 6.2 | 30.6 | 37.8 | 10.6 | 10.0 |
| 2513-25 | 15.3 | 6.9 | 28.6 | 37.3 | 12.0 | 9.4 |
| 2513-30 | 14.8 | 7.6 | 29.6 | 36.1 | 11.9 | 8.7 |
| 2513-15 | 13.0 | 5.6 | 35.3 | 36.0 | 10.1 | 8.4 |
| 2513-11 | 15.2 | 7.3 | 28.5 | 37.6 | 11.4 | 8.2 |
| 2513-29 | 15.3 | 5.7 | 22.6 | 42.4 | 13.9 | 7.4 |
| 2513-2 | 16.6 | 6.1 | 21.7 | 41.7 | 13.9 | 7.1 |
| 2513-7 | 16.1 | 7.4 | 28.0 | 35.9 | 12.6 | 7.0 |
| 2513-24 | 15.4 | 5.8 | 25.0 | 39.3 | 14.5 | 6.7 |
| 2513-8 | 16.9 | 4.6 | 21.3 | 42.5 | 14.7 | 6.6 |
| 2513-23 | 15.7 | 6.7 | 27.7 | 36.3 | 13.6 | 6.5 |
| 2513-6 | 16.6 | 6.4 | 23.5 | 38.6 | 14.9 | 6.3 |
| 2513-3 | 16.6 | 7.6 | 25.6 | 37.2 | 13.1 | 6.1 |
| 2513-27 | 16.7 | 6.1 | 21.2 | 40.5 | 15.4 | 5.8 |
| 2513-16 | 15.5 | 5.9 | 19.2 | 43.5 | 15.9 | 5.7 |
| 2513-17 | 17.0 | 5.7 | 20.6 | 39.6 | 17.2 | 5.5 |
| 2513-28 | 17.3 | 5.5 | 20.4 | 40.2 | 16.6 | 5.4 |
| 2513-21 | 15.7 | 6.9 | 23.6 | 35.4 | 18.3 | 5.1 |
| 2513-4 | 16.4 | 5.0 | 20.3 | 41.8 | 16.5 | 5.0 |
| 2513-26 | 17.7 | 5.6 | 19.9 | 41.1 | 15.7 | 4.9 |
| 2513-9 | 17.6 | 4.9 | 16.1 | 44.2 | 17.2 | 4.9 |
| 2513-1 | 19.0 | 6.0 | 19.8 | 38.4 | 16.9 | 4.6 |
| 2513-10 | 16.4 | 5.2 | 21.8 | 38.1 | 18.6 | 4.0 |
| Avg. | 15.0 | 6.1 | 27.4 | 38.7 | 12.7 | 8.5 |

Codon optimization of LS_DGAT1 and MA_DGAT1 substantially increased activity when expressed in soy.

Results for pKR1392 (CZ_DGAT2; SEQ ID NO:355; Experiment MSE2520), pKR1512 (CZ_DGAT2cod; SEQ ID NO:367; Experiment MSE2521), pKR1409 (MC_DGAT2; SEQ ID NO:360; Experiment MSE2522) and pKR1513 (MC_DGAT2cod; SEQ ID NO:369; Experiment MSE2523) are shown in Tables 92, Table 93, Table 94 and Table 95, respectively.

TABLE 92

Oil concentrations and fatty acid profiles for events from MSE2520 MSE2520 (CZ DGAT2)

| Event | 16:0 | 18:0 | 18:1 | 18:2 | 18:3 | % Oil |
|---|---|---|---|---|---|---|
| 2520-19 | 15.4 | 5.6 | 20.5 | 44.7 | 13.8 | 8.7 |
| 2520-4 | 16.4 | 5.5 | 20.7 | 40.0 | 17.4 | 5.5 |
| 2520-18 | 16.4 | 5.2 | 21.3 | 38.5 | 18.7 | 4.5 |
| 2520-23 | 17.2 | 5.7 | 18.8 | 39.8 | 18.5 | 4.4 |
| 2520-28 | 16.9 | 6.6 | 22.3 | 37.6 | 16.6 | 4.4 |
| 2520-10 | 17.3 | 5.2 | 20.1 | 39.1 | 18.2 | 4.2 |
| 2520-8 | 17.4 | 6.1 | 21.8 | 37.5 | 17.2 | 4.2 |
| 2520-13 | 18.0 | 6.0 | 20.0 | 38.4 | 17.5 | 4.2 |
| 2520-17 | 17.8 | 6.6 | 21.9 | 37.4 | 16.3 | 4.1 |
| 2520-14 | 17.2 | 6.6 | 24.9 | 34.4 | 16.9 | 4.1 |
| 2520-22 | 17.1 | 6.5 | 21.3 | 37.5 | 17.6 | 4.0 |
| 2520-25 | 16.2 | 5.3 | 21.9 | 37.2 | 19.4 | 4.0 |
| 2520-27 | 17.0 | 7.3 | 22.3 | 36.7 | 16.7 | 4.0 |
| 2520-3 | 16.9 | 4.3 | 16.3 | 41.0 | 21.6 | 3.9 |
| 2520-29 | 16.6 | 5.6 | 19.6 | 38.3 | 20.0 | 3.8 |
| 2520-9 | 17.0 | 5.4 | 20.7 | 38.0 | 18.9 | 3.8 |
| 2520-16 | 16.5 | 4.8 | 18.9 | 39.7 | 20.1 | 3.8 |
| 2520-24 | 16.7 | 5.8 | 21.3 | 37.8 | 18.4 | 3.7 |
| 2520-12 | 17.0 | 5.3 | 17.7 | 40.1 | 19.9 | 3.6 |
| 2520-7 | 18.2 | 5.2 | 15.8 | 41.3 | 19.4 | 3.6 |
| 2520-5 | 16.5 | 5.8 | 20.9 | 37.6 | 19.2 | 3.5 |
| 2520-15 | 17.2 | 4.7 | 15.0 | 39.8 | 23.3 | 3.3 |
| 2520-6 | 17.4 | 6.6 | 20.0 | 38.7 | 17.4 | 3.3 |
| 2520-21 | 17.2 | 5.3 | 17.4 | 39.3 | 20.9 | 3.3 |
| 2520-26 | 16.1 | 5.2 | 18.0 | 38.5 | 22.2 | 3.3 |
| 2520-20 | 16.7 | 5.9 | 17.4 | 38.9 | 21.1 | 3.3 |
| 2520-11 | 16.4 | 4.9 | 16.4 | 39.2 | 23.0 | 3.0 |
| 2520-30 | 17.6 | 5.9 | 20.1 | 38.0 | 18.4 | 3.0 |
| 2520-2 | 16.9 | 5.2 | 17.2 | 39.2 | 21.5 | 2.8 |
| 2520-1 | 20.9 | 4.5 | 15.1 | 38.2 | 21.3 | 2.8 |
| Avg. | 17.1 | 5.6 | 19.5 | 38.7 | 19.0 | 3.9 |

TABLE 93

Oil concentrations and fatty acid profiles for events from MSE2521 MSE2521 (CZ DGAT2cod)

| Event | 16:0 | 18:0 | 18:1 | 18:2 | 18:3 | % Oil |
|---|---|---|---|---|---|---|
| 2521-9 | 16.5 | 6.5 | 21.2 | 41.2 | 14.6 | 6.9 |
| 2521-19 | 16.2 | 6.8 | 23.0 | 38.5 | 15.5 | 5.8 |
| 2521-23 | 17.3 | 6.1 | 23.9 | 37.5 | 15.2 | 5.7 |
| 2521-30 | 17.0 | 6.0 | 21.2 | 38.3 | 17.5 | 5.6 |
| 2521-14 | 16.3 | 6.7 | 24.7 | 37.3 | 14.9 | 5.5 |
| 2521-20 | 16.6 | 6.1 | 24.0 | 38.1 | 15.2 | 5.5 |
| 2521-13 | 15.9 | 6.0 | 22.5 | 39.4 | 16.1 | 5.5 |
| 2521-10 | 16.4 | 5.7 | 23.7 | 39.0 | 15.3 | 5.5 |
| 2521-29 | 17.1 | 5.9 | 21.1 | 39.3 | 16.6 | 5.2 |
| 2521-3 | 16.7 | 5.5 | 19.9 | 40.2 | 17.7 | 5.0 |
| 2521-26 | 16.4 | 6.7 | 22.4 | 38.5 | 16.0 | 4.9 |
| 2521-31 | 17.2 | 6.1 | 19.9 | 38.9 | 17.9 | 4.8 |
| 2521-24 | 16.7 | 5.8 | 21.0 | 38.8 | 17.7 | 4.8 |
| 2521-6 | 17.1 | 5.4 | 21.4 | 37.8 | 18.3 | 4.7 |
| 2521-12 | 16.4 | 5.6 | 23.0 | 37.7 | 17.3 | 4.7 |
| 2521-5 | 16.7 | 6.4 | 23.3 | 37.2 | 16.4 | 4.5 |
| 2521-11 | 16.9 | 5.6 | 20.0 | 38.5 | 19.1 | 4.4 |
| 2521-2 | 17.1 | 5.7 | 20.2 | 39.7 | 17.3 | 4.4 |
| 2521-8 | 18.1 | 6.0 | 20.3 | 38.0 | 17.6 | 4.2 |
| 2521-16 | 17.7 | 5.2 | 19.1 | 38.9 | 19.0 | 4.1 |
| 2521-1 | 17.8 | 6.4 | 22.1 | 36.0 | 17.7 | 4.0 |

TABLE 93-continued

Oil concentrations and fatty acid profiles for events from MSE2521 MSE2521 (CZ DGAT2cod)

| Event | 16:0 | 18:0 | 18:1 | 18:2 | 18:3 | % Oil |
|---|---|---|---|---|---|---|
| 2521-21 | 17.1 | 4.8 | 17.9 | 39.7 | 20.4 | 3.8 |
| 2521-17 | 17.7 | 5.0 | 19.2 | 38.8 | 19.4 | 3.8 |
| 2521-28 | 16.0 | 4.6 | 18.9 | 40.3 | 20.2 | 3.5 |
| 2521-27 | 17.0 | 5.0 | 17.7 | 38.7 | 21.6 | 3.5 |
| 2521-22 | 17.5 | 4.6 | 17.1 | 39.7 | 21.2 | 3.3 |
| 2521-25 | 17.3 | 4.9 | 17.4 | 38.7 | 21.7 | 3.0 |
| 2521-7 | 17.6 | 4.7 | 14.7 | 39.7 | 23.3 | 3.0 |
| 2521-18 | 17.4 | 4.8 | 18.4 | 38.1 | 21.3 | 2.9 |
| 2521-4 | 17.1 | 4.9 | 16.4 | 38.6 | 23.1 | 2.8 |
| 2521-15 | 20.5 | 4.5 | 12.8 | 37.4 | 24.8 | 2.4 |
| Avg. | 17.1 | 5.6 | 20.3 | 38.7 | 18.4 | 4.4 |

TABLE 94

Oil concentrations and fatty acid profiles for events from MSE2522 MSE2522 (MC DGAT2)

| Event | 16:0 | 18:0 | 18:1 | 18:2 | 18:3 | % Oil |
|---|---|---|---|---|---|---|
| 2522-2 | 15.1 | 5.1 | 20.2 | 44.4 | 15.1 | 8.6 |
| 2522-28 | 14.9 | 6.7 | 25.1 | 38.1 | 15.1 | 6.3 |
| 2522-5 | 14.4 | 5.1 | 19.1 | 41.7 | 19.7 | 5.7 |
| 2522-19 | 15.8 | 7.7 | 28.2 | 35.0 | 13.3 | 5.6 |
| 2522-21 | 16.4 | 7.2 | 21.9 | 37.8 | 16.7 | 5.2 |
| 2522-23 | 17.0 | 4.8 | 19.7 | 41.0 | 17.4 | 5.2 |
| 2522-6 | 15.9 | 5.8 | 20.0 | 40.4 | 17.8 | 5.2 |
| 2522-1 | 17.3 | 6.4 | 19.3 | 36.6 | 20.5 | 4.8 |
| 2522-17 | 15.0 | 5.4 | 19.0 | 42.1 | 18.6 | 4.7 |
| 2522-18 | 16.0 | 5.3 | 18.0 | 39.6 | 21.0 | 4.7 |
| 2522-11 | 15.0 | 5.3 | 19.0 | 40.4 | 20.3 | 4.6 |
| 2522-12 | 15.5 | 4.9 | 16.1 | 40.8 | 22.8 | 4.5 |
| 2522-8 | 16.7 | 8.5 | 21.6 | 37.8 | 15.5 | 4.4 |
| 2522-16 | 14.8 | 6.5 | 21.6 | 38.2 | 18.9 | 4.4 |
| 2522-22 | 16.6 | 5.9 | 20.4 | 38.4 | 18.8 | 4.2 |
| 2522-9 | 15.9 | 7.1 | 19.2 | 40.0 | 17.8 | 4.2 |
| 2522-29 | 14.6 | 4.7 | 16.8 | 41.0 | 22.8 | 4.0 |
| 2522-26 | 16.9 | 4.2 | 14.7 | 42.2 | 22.1 | 4.0 |
| 2522-14 | 13.4 | 3.9 | 13.6 | 40.6 | 28.5 | 3.9 |
| 2522-30 | 16.0 | 4.8 | 20.3 | 36.7 | 22.2 | 3.9 |
| 2522-15 | 15.3 | 5.4 | 16.7 | 39.7 | 22.9 | 3.7 |
| 2522-10 | 14.1 | 4.1 | 13.9 | 40.6 | 27.3 | 3.7 |
| 2522-4 | 15.9 | 4.4 | 14.6 | 43.3 | 21.8 | 3.5 |
| 2522-25 | 15.7 | 6.1 | 22.0 | 36.2 | 20.1 | 3.5 |
| 2522-27 | 16.2 | 5.2 | 14.4 | 42.1 | 22.1 | 3.5 |
| 2522-3 | 16.4 | 7.2 | 20.7 | 39.9 | 15.8 | 3.5 |
| 2522-31 | 15.9 | 5.7 | 19.8 | 39.1 | 19.5 | 3.4 |
| 2522-13 | 15.2 | 5.5 | 15.1 | 39.5 | 24.7 | 3.2 |
| 2522-24 | 17.7 | 6.2 | 21.2 | 38.1 | 16.7 | 3.2 |
| 2522-20 | 15.4 | 5.3 | 15.5 | 39.6 | 24.3 | 2.9 |
| 2522-7 | 17.2 | 3.6 | 9.8 | 41.9 | 27.5 | 2.8 |
| Avg. | 15.7 | 5.6 | 18.6 | 39.8 | 20.2 | 4.4 |

TABLE 95

Oil concentrations and fatty acid profiles for events from MSE2523 MSE2523 (MC DGAT2cod)

| Event | 16:0 | 18:0 | 18:1 | 18:2 | 18:3 | % Oil |
|---|---|---|---|---|---|---|
| 2523-1 | 14.7 | 5.8 | 24.2 | 42.7 | 12.7 | 8.0 |
| 2523-5 | 15.4 | 5.7 | 27.2 | 39.9 | 11.9 | 8.0 |
| 2523-25 | 16.0 | 5.5 | 23.7 | 40.3 | 14.5 | 6.5 |
| 2523-18 | 16.4 | 5.9 | 23.1 | 39.3 | 15.3 | 6.0 |
| 2523-20 | 15.8 | 5.8 | 24.7 | 39.0 | 14.7 | 6.0 |
| 2523-19 | 17.2 | 5.8 | 23.7 | 37.6 | 15.7 | 5.5 |
| 2523-2 | 16.8 | 6.2 | 22.1 | 38.7 | 16.2 | 5.3 |
| 2523-23 | 16.4 | 5.4 | 24.3 | 38.6 | 15.3 | 5.2 |
| 2523-16 | 17.0 | 5.7 | 22.5 | 38.5 | 16.4 | 5.1 |
| 2523-17 | 16.8 | 5.5 | 23.4 | 37.7 | 16.7 | 5.1 |
| 2523-7 | 17.4 | 5.4 | 17.6 | 43.7 | 15.9 | 5.1 |

TABLE 95-continued

Oil concentrations and fatty acid profiles for events from MSE2523 MSE2523 (MC DGAT2cod)

| Event | 16:0 | 18:0 | 18:1 | 18:2 | 18:3 | % Oil |
|---|---|---|---|---|---|---|
| 2523-22 | 17.0 | 5.6 | 21.7 | 38.8 | 17.0 | 4.7 |
| 2523-4 | 16.5 | 7.0 | 19.6 | 40.1 | 16.8 | 4.6 |
| 2523-29 | 17.3 | 5.4 | 20.5 | 39.0 | 17.7 | 4.5 |
| 2523-6 | 17.2 | 5.9 | 23.3 | 37.6 | 16.0 | 4.5 |
| 2523-27 | 17.2 | 5.2 | 20.1 | 41.3 | 16.2 | 4.5 |
| 2523-28 | 16.8 | 5.3 | 21.4 | 38.8 | 17.7 | 4.5 |
| 2523-13 | 17.1 | 5.4 | 19.6 | 39.6 | 18.3 | 4.4 |
| 2523-14 | 17.2 | 5.2 | 21.0 | 37.9 | 18.7 | 4.1 |
| 2523-21 | 16.4 | 5.4 | 18.9 | 39.7 | 19.6 | 3.9 |
| 2523-30 | 16.8 | 5.6 | 16.7 | 40.0 | 21.0 | 3.8 |
| 2523-15 | 17.6 | 4.8 | 17.1 | 40.2 | 20.3 | 3.8 |
| 2523-8 | 17.2 | 5.5 | 17.5 | 41.6 | 18.2 | 3.7 |
| 2523-10 | 17.8 | 5.0 | 18.5 | 38.8 | 19.9 | 3.5 |
| 2523-3 | 17.3 | 4.7 | 17.2 | 39.2 | 21.5 | 3.5 |
| 2523-12 | 17.8 | 4.6 | 15.2 | 38.5 | 23.8 | 3.0 |
| 2523-9 | 16.6 | 4.3 | 15.0 | 39.8 | 24.2 | 2.9 |
| 2523-26 | 17.4 | 5.8 | 19.6 | 38.7 | 18.5 | 2.5 |
| Avg. | 16.8 | 5.5 | 20.7 | 39.5 | 17.5 | 4.7 |

Codon optimization of CZ_DGAT2 and MC_DGAT2 slightly increased activity when expressed in soy.

Results for pKR1427 (CC_DGAT2; SEQ ID NO:361; Experiment MSE2525) and pKR1522 (CC_DGAT2cod; SEQ ID NO:373; Experiment MSE2526) are shown in Tables 96 and Table 97, respectively.

TABLE 96

Oil concentrations and fatty acid profiles for events from MSE2525 MSE2525 (CC DGAT2)

| Event | 16:0 | 18:0 | 18:1 | 18:2 | 18:3 | % Oil |
|---|---|---|---|---|---|---|
| 2525-20 | 16.1 | 5.6 | 19.2 | 44.2 | 14.9 | 7.7 |
| 2525-2 | 16.6 | 6.1 | 20.6 | 42.2 | 14.4 | 6.2 |
| 2525-8 | 16.5 | 5.6 | 21.7 | 41.3 | 15.0 | 5.9 |
| 2525-10 | 16.6 | 6.9 | 26.5 | 35.8 | 14.3 | 5.9 |
| 2525-13 | 17.2 | 5.0 | 17.7 | 42.3 | 17.8 | 5.2 |
| 2525-21 | 17.2 | 6.7 | 24.2 | 35.9 | 16.1 | 5.1 |
| 2525-26 | 16.7 | 6.6 | 23.8 | 38.1 | 14.8 | 5.0 |
| 2525-14 | 16.6 | 6.1 | 21.3 | 38.8 | 17.2 | 4.9 |
| 2525-27 | 17.3 | 6.4 | 23.0 | 37.6 | 15.7 | 4.7 |
| 2525-30 | 18.0 | 4.8 | 15.2 | 42.5 | 19.4 | 4.7 |
| 2525-25 | 16.7 | 4.9 | 18.7 | 39.7 | 20.1 | 4.5 |
| 2525-7 | 17.6 | 5.7 | 22.5 | 37.5 | 16.8 | 4.4 |
| 2525-4 | 17.4 | 5.5 | 19.2 | 41.0 | 16.9 | 4.4 |
| 2525-22 | 19.4 | 4.9 | 18.4 | 38.0 | 19.3 | 4.4 |
| 2525-18 | 17.5 | 5.9 | 21.2 | 37.5 | 17.9 | 4.4 |
| 2525-3 | 17.6 | 4.8 | 17.5 | 37.7 | 22.3 | 4.1 |
| 2525-11 | 15.8 | 5.1 | 20.6 | 42.0 | 16.6 | 4.0 |
| 2525-29 | 18.4 | 4.9 | 16.0 | 42.6 | 18.1 | 3.9 |
| 2525-9 | 17.5 | 5.3 | 18.6 | 40.0 | 18.6 | 3.9 |
| 2525-19 | 16.7 | 5.6 | 20.4 | 38.3 | 19.0 | 3.9 |
| 2525-6 | 17.5 | 5.4 | 19.7 | 38.0 | 19.4 | 3.8 |
| 2525-24 | 17.3 | 5.3 | 18.7 | 39.7 | 19.1 | 3.7 |
| 2525-16 | 17.4 | 4.6 | 15.7 | 41.3 | 21.1 | 3.7 |
| 2525-15 | 16.8 | 4.5 | 16.9 | 39.4 | 22.4 | 3.6 |
| 2525-1 | 17.6 | 5.5 | 18.8 | 40.9 | 17.1 | 3.6 |
| 2525-5 | 16.2 | 4.9 | 17.1 | 40.5 | 21.2 | 3.4 |
| 2525-17 | 18.7 | 5.1 | 15.9 | 38.0 | 22.4 | 2.5 |
| Avg. | 17.2 | 5.5 | 19.6 | 39.7 | 18.1 | 4.5 |

TABLE 97

Oil concentrations and fatty acid profiles for events from MSE2526 MSE2526 (CC DGAT2cod)

| Event | 16:0 | 18:0 | 18:1 | 18:2 | 18:3 | % Oil |
|---|---|---|---|---|---|---|
| 2526-29 | 15.7 | 6.6 | 26.0 | 38.3 | 13.4 | 7.5 |
| 2526-28 | 15.3 | 5.8 | 28.9 | 36.9 | 13.2 | 7.0 |

TABLE 97-continued

Oil concentrations and fatty acid profiles for events from MSE2526
MSE2526 (CC DGAT2cod)

| Event | 16:0 | 18:0 | 18:1 | 18:2 | 18:3 | % Oil |
|---|---|---|---|---|---|---|
| 2526-10 | 17.1 | 6.1 | 21.5 | 40.5 | 14.7 | 6.7 |
| 2526-5 | 15.5 | 5.8 | 27.8 | 36.6 | 14.3 | 6.6 |
| 2526-14 | 16.4 | 6.7 | 25.1 | 36.9 | 14.9 | 6.1 |
| 2526-22 | 17.1 | 5.7 | 20.9 | 40.7 | 15.5 | 6.1 |
| 2526-2 | 16.8 | 7.4 | 23.1 | 38.0 | 14.7 | 6.0 |
| 2526-6 | 16.7 | 6.6 | 25.0 | 38.0 | 13.7 | 5.8 |
| 2526-17 | 17.2 | 5.4 | 20.3 | 38.9 | 18.2 | 5.4 |
| 2526-7 | 17.2 | 5.4 | 19.8 | 40.5 | 17.0 | 5.3 |
| 2526-3 | 17.9 | 6.4 | 23.2 | 36.2 | 16.3 | 5.3 |
| 2526-23 | 17.0 | 7.0 | 24.2 | 36.4 | 15.4 | 5.2 |
| 2526-20 | 16.1 | 5.1 | 23.4 | 38.1 | 17.3 | 5.2 |
| 2526-9 | 17.1 | 6.7 | 24.8 | 35.6 | 15.9 | 5.2 |
| 2526-27 | 17.6 | 5.7 | 20.5 | 38.3 | 17.9 | 4.9 |
| 2526-26 | 17.1 | 6.9 | 24.7 | 37.4 | 13.9 | 4.8 |
| 2526-8 | 16.8 | 5.6 | 24.1 | 37.3 | 16.2 | 4.8 |
| 2526-19 | 15.6 | 6.1 | 25.4 | 36.1 | 16.8 | 4.8 |
| 2526-12 | 19.9 | 6.1 | 21.5 | 34.1 | 18.4 | 4.7 |
| 2526-21 | 18.2 | 5.9 | 18.6 | 39.2 | 18.2 | 4.6 |
| 2526-16 | 17.8 | 5.0 | 16.3 | 40.4 | 20.5 | 4.3 |
| 2526-11 | 17.1 | 6.8 | 23.2 | 36.3 | 16.7 | 4.3 |
| 2526-1 | 17.4 | 5.9 | 20.2 | 38.5 | 18.0 | 4.0 |
| 2526-4 | 17.1 | 7.0 | 25.6 | 34.9 | 15.3 | 3.7 |
| 2526-24 | 17.8 | 4.7 | 13.0 | 44.3 | 20.1 | 3.3 |
| 2526-15 | 17.9 | 5.0 | 16.8 | 39.3 | 20.9 | 3.3 |
| 2526-18 | 17.7 | 5.2 | 16.0 | 39.2 | 21.9 | 3.2 |
| Avg. | 17.1 | 6.0 | 22.2 | 38.0 | 16.6 | 5.1 |

Codon optimization of CC_DGAT2 slightly increased activity when expressed in soy.

A summary for expression of all wild-type and codon-optimized and/or motif-altered DGATs in soy somatic embryos relative to wild-type YL DGAT2 is shown in FIG. 10. A codon optimized/motif-altered version of TD_DGAT2b was not tested as signified by ND in FIG. 10. For FIG. 10, each wild-type gene was tested as a set of experiments along with YL_DGAT2 as control and a percent activity relative to YL_DGAT2 was determined. For this, the top 5 events having highest oil concentrations from each experiment were first averaged then normalized relative to the average of the top 5 events for wild-type YL_DGAT2 in that experiment (Avg. % Oil of top 5 events for a given DGAT/Avg. % Oil of top 5 events for YL_DGAT2 (in that experimental set)×100%). For codon optimized/motif altered genes, a relative activity factor was determined for codon-optimized relative to wild-type activity in that experiment. For this, the top 5 events having highest oil concentrations were first averaged and then normalized relative to the average of the top 5 events for the wild-type gene in that experimental set (Avg. % Oil of top 5 events for codon-optimized and/or motif-altered DGAT/Avg. % Oil of top 5 events for wild-type DGAT). The codon-optimized/motif-altered relative activity factor was then multiplied by the specific gene % activity relative to YL_DGAT2 to normalize the codon-optimized/motif-altered activity to YL_DGAT2 (% activity relative to YL_DGAT2 x codon-optimized relative activity factor). In FIG. 10 for each DGAT gene, % activity relative to YL_DGAT2 (solid black bar) for wild-type is displayed first (checkered bars) followed by relative % activity for codon-optimized and/or motif-altered (white, or speckled bars). Relative activities for DGAT1 constructs are shown in the last three sets of FIG. 10.

SEQUENCE LISTING (375 sequences)

SEQ ID NO: 1 - DNA, 1581 bp, Yarrowia lipoytica
atggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtag

SEQ ID NO: 2 - DNA, 8325 bp, Artificial Sequence
  plasmid pYDA1
aaacggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgccttggcttttggcactgtatttcatttttagaggtacactacattcagtgaggtatggtaaggttgagggcataatgaaggcaccttgtactgacagtcacagacctctcaccgagaattttatgagatatactcgggttcattttaggctcatcgatcaggagagaccgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgggcgtcgttgcttgtgtgatttttgaggacccatccctttggtatataagtatactctggggttaaggttgcccgtgtagtctaggttatagttttcatgtgaaataccgagagccgagggagaataaacgggggtatttggacttgtttttttcgcggaaaagcgtcgaatcaaccctgcgggccttgcaccatgtccacgacgtgtttctcgccccaattcgccccttgcacgtcaaaattaggcctccatctagacccctccataacatgtgactgtggggaaaagtataagggaaaccatgcaaccatagacgacgtgaaagacggggaggaaccaatggaggccaaagaaatggggtagcaacagtccaggagacagacaaggagacaaggagagggcgcccgaaagatcggaaaaacaaacatgtccaattggggcagtgacggaaacgacacggacacttcagtacaatggaccgaccatctccaagccagggttattccggtatcaccttggccgtaacctcccgctggtacctgatattgtacacgttcacattcaatatactttcagctacaataagagaggctgtttgtcgggcatgtgtgtccgtcgtatggggtgatgtccgagggcgaaattcgctacaagcttaactctggcgcttgtccagtatgaatagacaagtcaagaccagtggtgccatgattgacagggaggtacaagacttcgatactcgagcattactcggacttgtggcgattgaacagacgggcgatcgcttctcccccgtattgccggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcgctgatgacactttggtctgaaagagatgcattttgaatcccaaacttgcagtgcccaagtgacatacatctccgcgttttggaaaatgttcagaaacagttgattgtgttggaatggggaatggggaatggaaaaatgactcaagtatcaattccaaaaacttctctggctggcagtacctactgtccatactactgcattttctccagtcaggccactctatactcgacgacacagtagtaaaacccagataatttcgacataaacaagaaaacagacccaataatatttatatatagtcagccgtttgtccagttcagactgtaatagccgaaaaaaaatccaaagtttctattctaggaaaatatattccaatatttttaattcttaatctcatttattttattctagcgaaatacatttcagctacttgagacatgtgatacccacaaatcggattcggactcggttgttcagaagagcatatggcattcgtgctcgcttgttcacgtattcttcctgttccatctcttggccgacaatcacacaaaaatggggttttttttttaattctaatgattcattacagcaaaattgagatatagcagaccacgtattccataatcaccaaggaagttcttgggcgtcttaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtc

SEQ ID NO: 3 - DNA, 7518 bp, Artificial Sequence
  plasmid pY75
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagc

SEQ ID NO: 4 - DNA, 9109 bp, Artificial Sequence
  plasmid pY75 YLDGAT1
catggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggcc

SEQ ID NO: 5 - DNA, 6849 bp, Artificial Sequence
  plasmid pRS425
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatgcttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtgggacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacataggggcagacattagaatggtatatccttgaaatatatatatatattgctgaaatgtaaaaggtaagaaaagttagaaagtaagacgattgctaaccacctattggaaaaaacaataggtccttaaataatattgtcaacttcaagtattgtgatgcaagcatttagtcatgaacgcttctctattctatatgaaaagccggttccggcctctcacctttcctttttctcccaatttttcagttgaaaaaggtatatgcgtcaggcgacctctgaaattaacaaaaaatttccagtcatcgaatttgattctgtgcgatagcgcccctgtgtgttctcgttatgttgaggaaaaaaataatggttgctaagagattcgaactcttgcatcttacgatacctgagtattcccacagttaactgcggtcaagatatttcttgaatcaggcgccttagaccgctcggccaaacaaccaattacttgttgagaaatagagtataattatcctataaatataacgtttttgaacacacatgaacaaggaagtacaggacaattgattttgaagagaatgtggattttgatgtaattgttgggattccatttttaataaggcaataatattaggtatgtggatatactagaagttctcctcgaccgtcgatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccactagttctagagcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 6 - DNA, 7494 bp, Artificial Sequence
  plasmid pGPD425
ggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatcgactacgtcgtaaggccgtttctgacagagtaaaattcttgagggaactttcaccattatgggaaatgcttcaagaaggtattgacttaaactccatcaaatggtcaggtcattgagtgttttttatttgttgtatttttttttttttagagaaaatcctccaatatcaaattaggaatcgtagtttcatgattttctgttacacctaactttttgtgtggtgccctcctccttgtcaatattaatgttaaagtgcaattctttttccttatcacgttgagccattagtatcaatttgcttacctgtattcctttactatcctcctttttctccttcttgataaatgtatgtagattgcgtatatagtttcgtctaccctatgaacatattccattttgtaatttcgtgtcgtttctattatgaatttcatttataaagtttatgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggccttaccttcttcaggcaagttcaatgacaatttcaacatcattgcagcagacaagatagtggcgatagggtcaaccttattctttggcaaatctggagcagaaccgtggcatggttcgtacaaaccaaatgcggtgttcttgtctggcaaagaggccaaggacgcagatggcaacaaacccaaggaacctgggataacggaggcttcatcggagatgatatcaccaaacatgttgctggtgattataataccatttaggtgggttgggttcttaactaggatcatggcggcagaatcaatcaattgatgttgaaccttcaatgtagggaattcgttcttgatggtttcctccacagtttttctccataatcttgaagaggccaaaagattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctgacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccagccacagcacctaacaaaacggcatcaaccttcttggaggcttccagcgcctcatctggaagtgggacacctgtagcatcgatagcagcaccaccaattaaatgattttcgaaatcgaacttgacattggaacgaacatcagaaatagctttaagaaccttaatggcttcggctgtgatttcttgaccaacgtggtcacctggcaaaacgacgatcttcttaggggcagacataggggcagacattagaatggtatatccttgaaatatatatatatattgctgaaatgtaaaaggtaagaaaagttagaaagtaagacgattgctaaccacctattggaaaaaacaataggtccttaaataatattgtcaacttcaagtattgtgatgcaagcatttagtcatgaacgcttctctattctatatgaaaagccggttccggcctctcacctttcctttttctcccaatttttcagttgaaaaaggtatatgcgtcaggcgacctctgaaattaacaaaaaatttccagtcatcgaatttgattctgtgcgatagcgcccctgtgtgttctcgttatgttgaggaaaaaaataatggttgctaagagattcgaactcttgcatcttacgatacctgagtattcccacagttaactgcggtcaagatatttcttgaatcaggcgccttagaccgctcggccaaacaaccaattacttgttgagaaatagagtataattatcctataaatataacgtttttgaacacacatgaacaaggaagtacaggacaattgattttgaagagaatgtggattttgatgtaattgttgggattccatttttaataaggcaataatattaggtatgtggatatactagaagttctcctcgaccgtcgatatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccactagtgatttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaaatgatgacacaaggcaattgacccacgcatgtatctatctcattttcttacaccttctattaccttctgctctctctgatttggaaaaagctgaaaaaaaaggttgaaaccagttccctgaaattattcccctacttgactaataagtatataaagacggtaggtattgattgtaattctgtaaatctatttcttaaacttcttaaattctacttttatagttagtcttttttttagttttaaaacaccaagaacttagtttcgaaatcccgc

SEQ ID NO: 7 - DNA, 36 bp, Artificial Sequence
  plasmid oYLDGAT2-1
gcggccgcatgactatcgactcacaatactacaagt

SEQ ID NO: 8 - DNA, 36 bp, Artificial Sequence
  plasmid oYLDGAT2-2
gcggccgcttactcaatcattcggaactctggggct

SEQ ID NO: 9 - DNA, 1545 bp, Yarrowia lipolytica
atgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaa

SEQ ID NO: 10 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIITTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLYREYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 11 - DNA, 9070 bp, Artificial Sequence
  plasmid pY75 YLDGAT2
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggccgcatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatctccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagcccagagttccgaatgattgagtaagc

SEQ ID NO: 12 - DNA, 32 bp, Artificial Sequence
  primer YDGAT1-F
gatcatccatggaagtccgacgacgaaaaatc

SEQ ID NO: 13 - DNA, 36 bp, Artificial Sequence
  primer YDGAT1-R
gatcaagcggccgcctactggttctgcttgtagttg

SEQ ID NO: 14 - DNA, 35 bp, Artificial Sequence
  primer YDGAT2-F
gatcatccatggctatcgactcacaatactacaag

SEQ ID NO: 15 - DNA, 37 bp, Artificial Sequence
  primer YDGAT2-R
gatcatgcggccgcttactcaatcattcggaactctg

SEQ ID NO: 16 - DNA, 1603 bp, Yarrowia lipolytica
gatcatccatggaagtccgacgacgaaaaatcgacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttattatctggcttacaactacaagcagaaccagtaggcggccgcttgatc

SEQ ID NO: 17 - DNA, 1567 bp, Yarrowia lipolytica
gatcatccatggctatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatctccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcatgatc

SEQ ID NO: 18 - DNA, 6991 bp, Artificial Sequence
  plasmid pFBAIN-MOD-1
gcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatgg

SEQ ID NO: 19 - DNA, 8568 bp, Artificial Sequence
  plasmid pFBAIN-YLDGAT1
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggaagtccgacgacgaaaaatcgacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttattatctggcttacaactacaagcagaaccagtaggc

SEQ ID NO: 20 - DNA, 8532 bp, Artificial Sequence
  plasmid pFBAIN-YLDGAT2
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggctatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatctccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 21 - DNA, 7049 bp, Artificial Sequence
  plasmid pKS123
agcttggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaaca

SEQ ID NO: 22 - DNA, 1098 bp, Artificial Sequence
  cal a24-4
aggatcctgcaggcagccaagaaggttttggagcgagttccaatctcaaaaccgccattcgaatacaatgatctgaagaaagcagtaccaccacattgtttttcacgaccactttcccgatccttgtatttcctctttcacgacattattgtaacatgtatccttttctacgtagcatcaaactacattcatatgctccctcgtttcctttcctgcatcgtatggcctgtttactggatctcccaaggagtttttctcggcagattgtggatgatcggccacgaatgcggtcatcatagcttcagtaattaccgttgggtcgacgatacagtcggttttctaatccatacggccaccctcactccctatttttccttcaaatatagccaccgtaatcaccatgcacacaccaattccatggaatacgacgaggttcatatcccgaaacgcaaatcagaagctctctactttgaatttctgggcaacaacccaatcggcttaatgatcaccatgctatgtaaactgactttcggatatgcagcttacattatgttcaattacacaggtaagaagcacaaatctgggggcttagcgagccacttctacccacaaagccctctctttaacgacagcgaacgtaaccatgttttgttctctgacatcgggatttgcatcgtcttgtacgcgtgttaccgtattgtgacggtcacaggggcaatgccggcattttatgtgtacggtattccttgggttataatgagtgctattctctttgcagcaacttatttacaacacactcatccttcaatccctcattatgatacaacggagtggaactggcttagaggggctttatcgacaattgatagagatttagggttcttcaacatgaacaaaacacattatcatgttatccaccatttgtttcctgtcattccggaataccatgcacaagaggcaaccgaggccatcaagcccatcttaggtcaatattacaagtatgatggtactccgtttctaaaggccttgtggagagaaatgaaggagtgtatttatgtagaatccgatgaaggtcagaagaaacctgcaggagatctt

SEQ ID NO: 23 - DNA, 30 bp, Artificial Sequence
  primer oCal-15
aggatcctgcaggcagccaagaaggttttg

SEQ ID NO: 24 - DNA, 29 bp, Artificial Sequence
  primer oCal-6
aagatctcctgcaggtttcttctgacctc

SEQ ID NO: 25 - DNA, 8138 bp, Artificial Sequence
  plasmid pKR53B
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatctcctgcaggtttcttctgaccttcatcggattctacataaatacactccttcatttctctccacaaggcctttagaaacggagtaccatcatacttgtaatattgacctaagatgggcttgatggcctcggttgcctcttgtgcatggtattccggaatgacaggaaacaaatggtggataacatgataatgtgttttgttcatgttgaagaaccctaaatctctatcaattgtcgataaagcccctctaagccagttccactccgttgtatcataatgagggattgaaggatgagtgtgttgtaaataagttgctgcaaagagaatagcactcattataacccaaggaataccgtacacataaaatgccggcattgcccctgtgaccgtcacaatacggtaacacgcgtacaagacgatgcaaatcccgatgtcagagaacaaaacatggttacgttcgctgtcgttaaagagagggctttgtgggtagaagtggctcgctaagcccccagatttgtgcttcttacctgtgtaattgaacataatgtaagctgcatatccgaaagtcagtttacatagcatggtgatcattaagccgattgggttgttgcccagaaattcaaagtagagagcttctgatttgcgtttcgggatatgaacctcgtcgtattccatggaattggtgtgtgcatggtgattacggtggctatatttgaaggaaaaatagggagtgagggtggccgtatggattagaaaaccgactgtatcgtcgacccaacggtaattactgaagctatgatgaccgcattcgtggccgatcatccacaatctgccgagaaaaactccttgggagatccagtaaacaggccatacgatgcaggaaaggaaacgagggagcatatgaatgtagtttgatgctacgtagaaaaggatacatgttacaataatgtcgtgaaagaggaaatacaaggatcgggaaagtggtcgtgaaaaacaatgtggtggtactgctttcttcagatcattgtattcgaatggcggttttgagattggaactcgctccaaaaccttcttggctgcctgcag

SEQ ID NO: 26 - DNA, 7085 bp, Artificial Sequence
  plasmid pKR72
gtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggatctcctgcaggatctggccggccggatctc

SEQ ID NO: 27 - DNA, 7085 bp, Artificial Sequence
  plasmid pKR85
cgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatctcctgcaggatctggccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacgg

SEQ ID NO: 28 - DNA, 22 bp, Artificial Sequence
  primer oKR85-1
actcgaggcgcgccgtcgacgg

SEQ ID NO: 29 - DNA, 18 bp, Artificial Sequence
  primer oKR85-2
aagatctggcgcgccaag

SEQ ID NO: 30 - DNA, 4827 bp, Artificial Sequence
  plasmid pPCR85
actcgaggcgcgccgtcgacggatccgtacgagatccggccggccagatcctgcaggagatccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatcaaaagcttggcgcgccagatcttgggctagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccgccc

SEQ ID NO: 31 - DNA, 15114 bp, Artificial Sequence
  plasmid pKR91
gatctggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatctcctgcaggatctggccggccggatctcgtacggatccgtcgacggcgcgcctcgagtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggatcgatccatcgcgatgtaccttttgttagtcagcctctcgattgctcatcgtcattacacagtaccgaagtttgatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttactccaccatctcgtccttattgaaaacgtgggtagcaccaaaacgaatcaagtcgctggaactgaagttaccaatcacgctggatgatttgccagttggattaatcttgcctttccccgcatgaataatattgatgaatgcatgcgtgaggggtagttcgatgttggcaatagctgcaattgccgcgacatcctccaacgagcataattcttcagaaaaatagcgatgttccatgttgtcagggcatgcatgatgcacgttatgaggtgacggtgctaggcagtattccctcaaagtttcatagtcagtatcatattcatcattgcattcctgcaagagagaattgagacgcaatccacacgctgcggcaaccttccggcgttcgtggtctatttgctcttggacgttgcaaacgtaagtgttggatcgatccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccccgcaagcttggagactggtgatttcagcgtgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagcgtgtcgtgctccaccatgttgacgaagattttcttcttgtcattgagtcgtaagagactctgtatgaactgttcgccagtctttacggcgagttctgttaggtcctctatttgaatctttgactccatggcctttgattcagtgggaactacctttttagagactccaatctctattacttgccttggtttgtgaagcaagccttgaatcgtccatactggaatagtacttctgatcttgagaaatatatctttctctgtgttcttgatgcagttagtcctgaatcttttgactgcatctttaaccttcttgggaaggtatttgatctcctggagattattgctcgggtagatcgtcttgatgagacctgctgcgtaagcctctctaaccatctgtgggttagcattctttctgaaattgaaaaggctaatcttctcattatcagtggtgaacatggtatcgtcaccttctccgtcgaacttcctgactagatcgtagagatagaggaagtcgtccattgtgatctctggggcaaaggagatctgaattaattcgatatggtggatttatcacaaatgggacccgccgccgacagaggtgtgatgttaggccaggactttgaaaatttgcgcaactatcgtatagtggccgacaaattgacgccgagttgacagactgcctagcatttgagtgaattatgtgaggtaatgggctacactgaattggtagctcaaactgtcagtatttatgtatatgagtgtatattttcgcataatctcagaccaatctgaagatgaaatgggtatctgggaatggcgaaatcaaggcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagctagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggtccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaagggaacgcatgaagttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaagacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcaattcggtcgatatggctattacgaagaaggctcgtgcgcggagtcccgtgaactttcccacgcaacaagtgaaccgcaccgggtttgccggaggccatttcgttaaaatgcgcagccatggctgcttcgtccagcatggcgtaatactgatcctcgtcttcggctggcggtatattgccgatgggcttcaaaagccgccgtggttgaaccagtctatccattccaaggtagcgaactcgaccgcttcgaagctcctccatggtccacgccgatgaatgacctcggccttgtaaagaccgttgatcgcttctgcgagggcgttgtcgtgctgtcgccgacgcttccgatagatggctcgatacctgcttctgccaaccgctcggaatagcgaaaggacacgtattgaacaccgcgatccgagtgatgcactaggccgccatgagcgggacgccgatcatgatgagcctcctcgagggcatcgaggacaaagcctgcatgtgctgtccggctcgcccgccatccgacaatgcgacgggcgaagacgtcgatcacgaaggccacgtagacgaagccctcccaagtggcgacataagtacggacatgcgcaaaggctttcccggtttgtcgctgatggtgcaagagacgctgaagcgcgatccgatgcgcaggcatctgttcgtcttccgcggtcgtggcggtggcctgatcaaggtcactcgccgaagagctgcatgattggctcgaaaccgagcgggggaaattgtcgcgcagttctcccgtcgccgaggcgataaattacatgctcaagcgatgggatggcattacgtcattcctcgatgacggcccgatttgcctgacgaacaatgctgccgaacgaacgctcagaggctatgtactcggcaggaagtcatggctgtttgccggatcggatcgttgtgctgaacgtgcggcgttcatggcgacactgatcatgagcgccaagctcaataacatcgatccgcaggcctggcttgccgacgtccgcgccgaccttgcggacgctccgatcagcaggcttgagcaacagctgccgtggaactggacatccaagacactgagtgctcaggcggcctgacctgcggccttcaccggatacttaccccattatcgcagattgcgatgaagcatcagcgtcattcagcaatcttgccaaagtatgcaggctcgcgagaatcgacgtgcgaaaccggctggttgcgccaaagatccgcttgcggagcggtcgaacattcatgctgggacttcaagaggtcgagtagaggaagaaccggaaaggttgcaccggaaaatatgcgttcctttggagagcgcctcatggacgtgaacaaatcgcccggaccaaggatgccacggatacaaaagctcgcgaagctcggtcccgtgggtgttctgtcgtctcgttgtacaacgaaatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcgatccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagag

SEQ ID NO: 32 - DNA, 13268 bp, Artificial Sequence
  plasmid pKR92
cgcgcctcgagtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggatcgatccatcgcgatgtaccttttgttagtcagcctctcgattgctcatcgtcattacacagtaccgaagtttgatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttactccaccatctcgtccttattgaaaacgtgggtagcaccaaaacgaatcaagtcgctggaactgaagttaccaatcacgctggatgatttgccagttggattaatcttgcctttccccgcatgaataatattgatgaatgcatgcgtgaggggtagttcgatgttggcaatagctgcaattgccgcgacatcctccaacgagcataattcttcagaaaaatagcgatgttccatgttgtcagggcatgcatgatgcacgttatgaggtgacggtgctaggcagtattccctcaaagtttcatagtcagtatcatattcatcattgcattcctgcaagagagaattgagacgcaatccacacgctgcggcaaccttccggcgttcgtggtctatttgctcttggacgttgcaaacgtaagtgttggatcgatccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccccgcaagcttggagactggtgatttcagcgtgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagcgtgtcgtgctccaccatgttgacgaagattttcttcttgtcattgagtcgtaagagactctgtatgaactgttcgccagtctttacggcgagttctgttaggtcctctatttgaatctttgactccatggcctttgattcagtgggaactacctttttagagactccaatctctattacttgccttggtttgtgaagcaagccttgaatcgtccatactggaatagtacttctgatcttgagaaatatatctttctctgtgttcttgatgcagttagtcctgaatcttttgactgcatctttaaccttcttgggaaggtatttgatctcctggagattattgctcgggtagatcgtcttgatgagacctgctgcgtaagcctctctaaccatctgtgggttagcattctttctgaaattgaaaaggctaatcttctcattatcagtggtgaacatggtatcgtcaccttctccgtcgaacttcctgactagatcgtagagatagaggaagtcgtccattgtgatctctggggcaaaggagtctgaattaattcgatatggtggatttatcacaaatgggacccgccgccgacagaggtgtgatgttaggccaggactttgaaaatttgcgcaactatcgtatagtggccgacaaattgacgccgagttgacagactgcctagcatttgagtgaattatgtgaggtaatgggctacactgaattggtagctcaaactgtcagtatttatgtatatgagtgtatattttcgcataatctcagaccaatctgaagatgaaatgggtatctgggaatggcgaaatcaaggcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagctagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggtccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaagggaacgcatgaagttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaagacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcaattcggtcgatatggctattacgaagaaggctcgtgcgcggagtcccgtgaactttcccacgcaacaagtgaaccgcaccgggtttgccggaggccatttcgttaaaatgcgcagccatggctgcttcgtccagcatggcgtaatactgatcctcgtcttcggctggcggtatattgccgatgggcttcaaaagccgccgtggttgaaccagtctatccattccaaggtagcgaactcgaccgcttcgaagctcctccatggtccacgccgatgaatgacctcggccttgtaaagaccgttgatcgcttctgcgagggcgttgtcgtgctgtcgccgacgcttccgatagatggctcgatacctgcttctgccaaccgctcggaatagcgaaaggacacgtattgaacaccgcgatccgagtgatgcactaggccgccatgagcgggacgccgatcatgatgagcctcctcgagggcatcgaggacaaagcctgcatgtgctgtccggctcgcccgccatccgacaatgcgacgggcgaagacgtcgatcacgaaggccacgtagacgaagccctcccaagtggcgacataagtacggacatgcgcaaaggctttcccggtttgtcgctgatggtgcaagagacgctgaagcgcgatccgatgcgcaggcatctgttcgtcttccgcggtcgtggcggtggcctgatcaaggtcactcgccgaagagctgcatgattggctcgaaaccgagcgggggaaattgtcgcgcagttctcccgtcgccgaggcgataaattacatgctcaagcgatgggatggcattacgtcattcctcgatgacggcccgatttgcctgacgaacaatgctgccgaacgaacgctcagaggctatgtactcggcaggaagtcatggctgtttgccggatcggatcgttgtgctgaacgtgcggcgttcatggcgacactgatcatgagcgccaagctcaataacatcgatccgcaggcctggcttgccgacgtccgcgccgaccttgcggacgctccgatcagcaggcttgagcaacagctgccgtggaactggacatccaagacactgagtgctcaggcggcctgacctgcggccttcaccggatacttaccccattatcgcagattgcgatgaagcatcagcgtcattcagcaatcttgccaaagtatgcaggctcgcgagaatcgacgtgcgaaaccggctggttgcgccaaagatccgcttgcggagcggtcgaacattcatgctgggacttcaagaggtcgagtagaggaagaaccggaaaggttgcaccggaaaatatgcgttcctttggagagcgcctcatggacgtgaacaaatcgcccggaccaaggatgccacggatacaaaagctcgcgaagctcggtcccgtgggtgttctgtcgtctcgttgtacaacgaaatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcgatccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatctgg

SEQ ID NO: 33 - DNA, 19604 bp, Artificial Sequence
  plasmid pKR92 YLDGAT2
  misc_feature (4526)..(4526): n is a, c, g, or t
cgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatctccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgcctcgagtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggatcgatccatcgcgatgtaccttttgttagtcagcctctcgattgctcatcgtcattacacagtaccgaagtttgatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttactccaccatctcgtccttattgaaaacgtgggtagcaccaaaacgaatcaagtcgctggaactgaagttaccaatcacgctggatgatttgccagttggattaatcttgcctttccccgcatgaataatattgatgaatgcatgcgtgaggggtagttcgatgttggcaatagctgcaattgccgcgacatcctccaacgagcataattcttcagaaaaatagcgatgttccatgttgtcagggcatgcatgatgcacgttatgaggtgacggtgctaggcagtattccctcaaagtttcatagtcagtatcatattcatcattgcattcctgcaagagagaattgagacgcaatccacacgctgcggcaaccttccggcgttcgtggtctatttgctcttggacgttgcaaacgtaagtgttggatcgatccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccccgcaagcttggagactggtgatttcagcgtgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagcgtgtcgtgctccaccatgttgacgaagattttcttcttgtcattgagtcgtaagagactctgtatgaactgttcgccagtctttacggcgagttctgttaggtcctctatttgaatctttgactccatggcctttgattcagtgggaactacctttttagagactccaatctctattacttgccttggtttgtgaagcaagccttgaatcgtccatactggaatagtacttctgatcttgagaaatatatctttctctgtgttcttgatgcagttagtcctgaatcttttgactgcatctttaaccttcttgggaaggtatttgatctcctggagattattgctcgggtagatcgtcttgatgagacctgctgcgtaagcctctctaaccatctgtgggttagcattctttctgaaattgaaaaggctaatcttctcattatcagtggtgaacatggtatcgtcaccttctccgtcgaacttcctgactagatcgtagagatagaggaagtcgtccattgtgatctctggggcaaaggagtctgaattaattcgatatggtggatttatcacaaatgggacccgccgccgacagaggtgtgatgttaggccaggactttgaaaatttgcgcaactatcgtatagtggccgacaaattgacgccgagttgacagactgcctagcatttgagtgaattatgtgaggtaatgggctacactgaattggtagctcaaactgtcagtatttatgtatatgagtgtatattttcgcataatctcagaccaatctgaagatgaaatgggtatctgggaatggcgaaatcaaggcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagctagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggtccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaagggaacgcatgaagttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaagacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcaattcggtcgatatggctattacgaagaaggctcgtgcgcggagtcccgtgaactttcccacgcaacaagtgaaccgcaccgggtttgccggaggccatttcgttaaaatgcgcagccatggctgcttcgtccagcatggcgtaatactgatcctcgtcttcggctggcggtatattgccgatgggcttcaaaagccgccgtggttgaaccagtctatccattccaaggtagcgaactcgaccgcttcgaagctcctccatggtccacgccgatgaatgacctcggccttgtaaagaccgttgatcgcttctgcgagggcgttgtcgtgctgtcgccgacgcttccgatagatggctcgatacctgcttctgccaaccgctcggaatagcgaaaggacacgtattgaacaccgcgatccgagtgatgcactaggccgccatgagcgggacgccgatcatgatgagcctcctcgagggcatcgaggacaaagcctgcatgtgctgtccggctcgcccgccatccgacaatgcgacgggcgaagacgtcgatcacgaaggccacgtagacgaagccctcccaagtggcgacataagtacggacatgcgcaaaggctttcccggtttgtcgctgatggtgcaagagacgctgaagcgcgatccgatgcgcaggcatctgttcgtcttccgcggtcgtggcggtggcctgatcaaggtcactcgccgaagagctgcatgattggctcgaaaccgagcgggggaaattgtcgcgcagttctcccgtcgccgaggcgataaattacatgctcaagcgatgggatggcattacgtcattcctcgatgacggcccgatttgcctgacgaacaatgctgccgaacgaacgctcagaggctatgtactcggcaggaagtcatggctgtttgccggatcggatcgttgtgctgaacgtgcggcgttcatggcgacactgatcatgagcgccaagctcaataacatcgatccgcaggcctggcttgccgacgtccgcgccgaccttgcggacgctccgatcagcaggcttgagcaacagctgccgtggaactggacatccaagacactgagtgctcaggcggcctgacctgcggccttcaccggatacttaccccattatcgcagattgcgatgaagcatcagcgtcattcagcaatcttgccaaagtatgcaggctcgcgagaatcgacgtgcgaaaccggctggttgcgccaaagatccgcttgcggagcggtcgaacattcatgctgggacttcaagaggtcgagtagaggaagaaccggaaaggttgcaccggaaaatatgcgttcctttggagagcgcctcatggacgtgaacaaatcgcccggaccaaggatgccacggatacaaaagctcgcgaagctcggtcccgtgggtgttctgtcgtctcgttgtacaacgaaatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcgatccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatctgg

SEQ ID NO: 34 - DNA, 20082 bp, Artificial Sequence
  plasmid pKR92 YLDGAT1 YLDGAT2
cgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatctccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcgtcgacggcgcgcctcgagtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggatcgatccatcgcgatgtaccttttgttagtcagcctctcgattgctcatcgtcattacacagtaccgaagtttgatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttactccaccatctcgtccttattgaaaacgtgggtagcaccaaaacgaatcaagtcgctggaactgaagttaccaatcacgctggatgatttgccagttggattaatcttgcctttccccgcatgaataatattgatgaatgcatgcgtgaggggtagttcgatgttggcaatagctgcaattgccgcgacatcctccaacgagcataattcttcagaaaaatagcgatgttccatgttgtcagggcatgcatgatgcacgttatgaggtgacggtgctaggcagtattccctcaaagtttcatagtcagtatcatattcatcattgcattcctgcaagagagaattgagacgcaatccacacgctgcggcaaccttccggcgttcgtggtctatttgctcttggacgttgcaaacgtaagtgttggatcgatccggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatccccgcaagcttggagactggtgatttcagcgtgtcctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagcgtgtcgtgctccaccatgttgacgaagattttcttcttgtcattgagtcgtaagagactctgtatgaactgttcgccagtctttacggcgagttctgttaggtcctctatttgaatctttgactccatggcctttgattcagtgggaactacctttttagagactccaatctctattacttgccttggtttgtgaagcaagccttgaatcgtccatactggaatagtacttctgatcttgagaaatatatctttctctgtgttcttgatgcagttagtcctgaatcttttgactgcatctttaaccttcttgggaaggtatttgatctcctggagattattgctcgggtagatcgtcttgatgagacctgctgcgtaagcctctctaaccatctgtgggttagcattctttctgaaattgaaaaggctaatcttctcattatcagtggtgaacatggtatcgtcaccttctccgtcgaacttcctgactagatcgtagagatagaggaagtcgtccattgtgatctctggggcaaaggagtctgaattaattcgatatggtggatttatcacaaatgggacccgccgccgacagaggtgtgatgttaggccaggactttgaaaatttgcgcaactatcgtatagtggccgacaaattgacgccgagttgacagactgcctagcatttgagtgaattatgtgaggtaatgggctacactgaattggtagctcaaactgtcagtatttatgtatatgagtgtatattttcgcataatctcagaccaatctgaagatgaaatgggtatctgggaatggcgaaatcaaggcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagctagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggtccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaagggaacgcatgaagttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaagacctgcaggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttcccccccccccctgcaggtcaattcggtcgatatggctattacgaagaaggctcgtgcgcggagtcccgtgaactttcccacgcaacaagtgaaccgcaccgggtttgccggaggccatttcgttaaaatgcgcagccatggctgcttcgtccagcatggcgtaatactgatcctcgtcttcggctggcggtatattgccgatgggcttcaaaagccgccgtggttgaaccagtctatccattccaaggtagcgaactcgaccgcttcgaagctcctccatggtccacgccgatgaatgacctcggccttgtaaagaccgttgatcgcttctgcgagggcgttgtcgtgctgtcgccgacgcttccgatagatggctcgatacctgcttctgccaaccgctcggaatagcgaaaggacacgtattgaacaccgcgatccgagtgatgcactaggccgccatgagcgggacgccgatcatgatgagcctcctcgagggcatcgaggacaaagcctgcatgtgctgtccggctcgcccgccatccgacaatgcgacgggcgaagacgtcgatcacgaaggccacgtagacgaagccctcccaagtggcgacataagtacggacatgcgcaaaggctttcccggtttgtcgctgatggtgcaagagacgctgaagcgcgatccgatgcgcaggcatctgttcgtcttccgcggtcgtggcggtggcctgatcaaggtcactcgccgaagagctgcatgattggctcgaaaccgagcgggggaaattgtcgcgcagttctcccgtcgccgaggcgataaattacatgctcaagcgatgggatggcattacgtcattcctcgatgacggcccgatttgcctgacgaacaatgctgccgaacgaacgctcagaggctatgtactcggcaggaagtcatggctgtttgccggatcggatcgttgtgctgaacgtgcggcgttcatggcgacactgatcatgagcgccaagctcaataacatcgatccgcaggcctggcttgccgacgtccgcgccgaccttgcggacgctccgatcagcaggcttgagcaacagctgccgtggaactggacatccaagacactgagtgctcaggcggcctgacctgcggccttcaccggatacttaccccattatcgcagattgcgatgaagcatcagcgtcattcagcaatcttgccaaagtatgcaggctcgcgagaatcgacgtgcgaaaccggctggttgcgccaaagatccgcttgcggagcggtcgaacattcatgctgggacttcaagaggtcgagtagaggaagaaccggaaaggttgcaccggaaaatatgcgttcctttggagagcgcctcatggacgtgaacaaatcgcccggaccaaggatgccacggatacaaaagctcgcgaagctcggtcccgtgggtgttctgtcgtctcgttgtacaacgaaatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcgatccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatctgg

SEQ ID NO: 35 - DNA, 3527 bp, Glycine max
tagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgttgtccctcattcaccttcctctcttccctataaataaccacgcctcaggttctccgcttcacaactcaaacattctcctccattggtccttaaacactcatcagtcatcaccatggccaagctagttttttccctttgttttctgcttttcagtggctgctgcttcgctttcagttccagagagcagcctcagcaaaacgagtgccagatccaaaaactcaatgccctcaaaccggataaccgtatagagtcagaaggagggctcattgagacatggaaccctaacaacaagccattccagtgtgccggtgttgccctctctcgctgcaccctcaaccgcaacgcccttcgtagaccttcctacaccaacggtccccaggaaatctacatccaacaaggtccatcttgtccaaacttcacatataaatatataatagacttaaatatgtttaagggtttgataaatgagggaattttattttagatttttaataattttttttgttttgagtttttatatattaaaatttttgttttgatttcttccatatgacgtaacataatcatatcattgataatgttgggttcctaatttttgtttgtttgttgttttgtaatatgaataggtaagggtatttttggcatgatatacccgggttgtcctagcacatttgaagagcctcaacaacctcaacaaagaggacaaagcagcagaccacaagaccgtcaccagaagatctataacttcagagagggtgatttgatcgcagtgcctactggtgttgcatggtggatgtacaacaatgaagacactcctgttgttgccgtttctattattgacaccaacagcttggagaaccagctcgaccagatgcctagggtgagccacatagcaatattagatattataattctttaaaggtttaaatatcattttagttcgtggagttgcactttctaatttagtacctatagattaaaatatgccaattgaatccttatagttgtgtttttttatccaatttggttcttgtcttgaaataaatggacaatattgtagctgataaaaaaaggaaactggactacattgtaacgttaagattagaattcttaagttctaatactagctggttacagattgacaactatttgttttgacaattcttggcagagattctatcttgctgggaaccaagagcaagagtttctaaaatatcagcaagagcaaggaggtcatcaaagccagaaaggaaagcatcagcaagaagaagaaaacgaaggaggcagcatattgagtggcttcaccctggaattcttggaacatgcattcagcgtggacaagcagatagcgaaaaacctacaaggagagaacgaaggggaagacaagggagccattgtgacagtgaaaggaggtctgagcgtgataaaaccacccacggacgagcagcaacaaagaccccaggaagaggaagaagaagaagaggatgagaagccacagtgcaagggtaaagacaaacactgccaacgcccccgaggaagccaaagcaaaagcagaagaaatggcattgacgagaccatatgcaccatgagacttcgccacaacattggccagacttcatcacctgacatctacaaccctcaagccggtagcgtcacaaccgccaccagccttgacttcccagccctctcgtggctcagactcagtgctgagtttggatctctccgcaaggtacgtacatcattcatcaaagatcaacatacatttatacattaaactaatatttgttgccaaatatttattaattttattgataattaatttttttagaaaatttgtttgatcacttttaatggagtctttcatcttaattacattatttatacttagactaatgatttattgattaataataatcttagatacactataaaatgtgtgacggagttatcttaacacttgcatggattctatcttttctgtctttatatatagaaatagagagaaaaaaaaagaaaagattgatgaaaaaagcaaaacaaaaaatagtattattataaaaatattggatgaatttgttgtgactcttgcatgcattgatgtacgatgcagaatgcaatgttcgtgccacactacaacctgaacgcgaacagcataatatacgcattgaatggacgggcattgatacaagtggtgaattgcaacggtgagagagtgtttgatggagagctgcaagagggacgggtgctgatcgtgccacaaaactttgtggtggctgcaagatcacagagtgacaacttcgagtatgtgtcattcaagaccaatgatacacccatgatcggcactcttgcaggggcaaactcattgttgaacgcattaccagaggaagtgattcagcacactttcaacctaaaaagccagcaggccaggcagataaagaacaacaaccctttcaagttcctggttccacctcaggagtctcagaagagagctgtggcttagagccctttttgtatgtgctaccccacttttgtctttttggcaatagtgctagcaaccaataaataataataataataatgaataagaaaacaaaggctttagcttgccttttgttcactgtaaaataataatgtaagtactctctataatgagtcacgaaacttttgcgggaataaaaggagaaattccaatgagttttctgtcaaatcttcttttgtctctctctctctctcttttttttttctttcttctgagcttcttgcaaaacaaaaggcaaacaataacgattggtccaatgatagttagcttgatcgatgatatctttaggaagtgttggcaggacaggacatgatgtagaagactaaaattgaaagtattgcagacccaatagttgaagattaactttaagaatgaagacgtcttatcaggttcttcatgacttggagctc

SEQ ID NO: 36 - DNA, 690 bp, Glycine max
tagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgttgtccctcattcaccttcctctcttccctataaataaccacgcctcaggttctccgcttcacaactcaaacattctcctccattggtccttaaacactcatcagtcatcacc

SEQ ID NO: 37 - DNA, 36 bp, Artificial Sequence
  primer oGY1-1
cgcggatcctagcctaagtacgtactcaaaatgcca

SEQ ID NO: 38 - DNA, 39 bp, Artificial Sequence
  primer oGY1-2
gaattcccatggggtgatgactgatgagtgtttaaggac

SEQ ID NO: 39 - DNA, 6660 bp, Artificial Sequence
  plasmid pZBL114
cggtgcgggcctcttcgctattacgccagctggcgaaagggggatgtgctgcaaggcgattaagttgggtaacgccagggttttcccagtcacgacgttgtaaaacgacggccagtgccaagctgacttggtcagcggccgctctagaactagtggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggccaacagttcctgattaaccacaaaccgttctactttactggctttggtcgtcatgaagatgcggacttacgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaagtgcacgggaatatttcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgaatcaacaactctcctggcgcaccatcgtcggctacagcctcggtggggaattccccgggggtacctctagacatggccacgtgcatgaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggacgactctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctttgctctagactggaattcgtcgacgagctccctatagtgagtcgtattagaggccgacttggccaaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacaaaatattaacgtttacaatttcccattcgccattcaggctgcgcaactgttgggaagggcgat

SEQ ID NO: 40 - DNA, 1437 bp, Artificial Sequence
  GM GY1 gene
atgggttccagagagcagcctcagcaaaacgagtgccagatccaaaaactcaatgccctcaaaccggataaccgtatagagtcagaaggagggctcattgagacatggaaccctaacaacaagccattccagtgtgccggtgttgccctctctcgctgcaccctcaaccgcaacgcccttcgtagaccttcctacaccaacggtccccaggaaatctacatccaacaaggtaagggtatttttggcatgatatacccgggttgtcctagcacatttgaagagcctcaacaacctcaacaaagaggacaaagcagcagaccacaagaccgtcaccagaagatctataacttcagagagggtgatttgatcgcagtgcctactggtgttgcatggtggatgtacaacaatgaagacactcctgttgttgccgtttctattattgacaccaacagcttggagaaccagctcgaccagatgcctaggagattctatcttgctgggaaccaagagcaagagtttctaaaatatcagcaagagcaaggaggtcatcaaagccagaaaggaaagcatcagcaagaagaagaaaacgaaggaggcagcatattgagtggcttcaccctggaattcttggaacatgcattcagcgtggacaagcagatagcgaaaaacctacaaggagagaacgaaggggaagacaagggagccattgtgacagtgaaaggaggtctgagcgtgttaaaaccacccacggacgagcagcaacaaagaccccaggaagaggaagaagaagaagaggatgagaagccacagtgcaagggtaaagacaaacactgccaacgcccccgaggaagccaaagcaaaagcagaagaaatggcattgacgagaccatatgcaccatgagacttcgccacaacattggccagacttcatcacctgacatctacaaccctcaagccggtagcgtcacaaccgccaccagccttgacttcccagccctctcgtggctcagactcagtgctgagtttggatctctccgcaagaatgcaatgttcgtgccacactacaacctgaacgcgaacagcataatatacgcattgaatggacgggcattgatacaagtggtgaattgcaacggtgagagagtgtttgatggagagctgcaagagggacgggtgctgatcgtgccacaaaactttgtggtggctgcaagatcacagagtgacaacttcgagtatgtgtcattcaagaccaatgatacacccatgatcggcactcttgcaggggcaaactcattgttgaacgcattaccagaggaagtgattcagcacactttcaacctaaaaagccagcaggccaggcagataaagaacaacaaccctttcaagttcctggttccacctcaggagtctcagaagagagctgtggcttagggtacc

SEQ ID NO: 41 - DNA, 204 bp, Artificial Sequence
  synthetic BHL8 gene
atggctaagattaagtgcacgtggcctgagctggtgggcaagaccgtggagaaagccaagaagatgatcatgaaggacaagccagaggcgaagatcatggttctgccagttgggaccaaagtgaccggtgaatggaagatggatcgcgtccgcctctgggtcgataagaaggacaagatcgccaagactccgaagtgcggctag

SEQ ID NO: 42 - DNA, 1701 bp, Artificial Sequence
  GY1-BHL8 fusion product
atggccaagctagttttttccctttgttttctgcttttcagtggctgctgcttcgctttcagttccagagagcagcctcagcaaaacgagtgccagatccaaaaactcaatgccctcaaaccggataaccgtatagagtcagaaggagggctcattgagacatggaaccctaacaacaagccattccagtgtgccggtgttgccctctctcgctgcaccctcaaccgcaacgcccttcgtagaccttcctacaccaacggtccccaggaaatctacatccaacaaggtaagggtatttttggcatgatatacccgggttgtcctagcacatttgaagagcctcagcaacctcaacaaagaggacaaagcagcagaccacaagaccgtcaccagaagatctataacttcagagagggtgatttgatcgcagtgcctactggtgttgcatggtggatgtacaacaatgaagacactcctgttgttgccgtttctattattgacaccaacagcttggagaaccagctcgaccagatgcctaggagattctatcttgctgggaaccaagagcaagagtttctaaaatatcagcaagagcaaggaggtcatcaaagccagaaaggaaagcatcagcaagaagaagaaaacgaaggaggcagcatattgagtggcttcaccctggaattcttggaacatgcattcagcgtggacaagcagatagcgaaaaacctacaaggagagaacgaaggggaagacaagggagccattgtgacagtgaaaggaggtctgagcgtgttaaaaccacccacggacgagcagcaacaaagaccccaggaagaggaagaagaagaagaggatgagaagccacagtgcaagggtaaagacaaacactgccaacgcccccgaggaagccaaagcaaaagcagaagaaatggcattgacgagaccatatgcaccatgagacttcgccacaacattggccagacttcatcacctgacatctacaaccctcaagccggtagcgtcacaaccgccaccagccttgacttcccagccctctcgtggctcagactcagtgctgagtttggatctctccgcaagaatgcaatgttcgtgccacactacaacctgaacgcgaacagcataatatacgcattgaatggacgggcattgatacaagtggtgaattgcaacggtgagagagtgtttgatggagagctgcaagagggacgggtgctgatcgtgccacaaaactttgtggtggctgcaagatcacagagtgacaacttcgagtatgtgtcattcaagaccaatgatacacccatgatcggcactcttgcaggggcaaactcattgttgaacgcattaccagaggaagtgattcagcacactttcaacctaaaaagccagcaggccaggcagataaagaacaacaaccctttcaagttcctggttccacctcaggagtctcagaagagagctgtggctggtggtggatctatggctaagattaagtgcacgtggcctgagctggtgggcaagaccgtggagaaagccaagaagatgatcatgaaggacaagccagaggcgaagatcatggttctgccagttgggaccaaagtgaccggtgaatggaagatggatcgcgtccgcctctgggtcgataagaaggacaagatcgccaagactccgaagtgcggctag

SEQ ID NO: 43 - DNA, 6493 bp, Artificial Sequence
  plasmid pZBL133
cggtgcgggcctcttcgctattacgccagctggcgaaagggggatgtgctgcaaggcgattaagttgggtaacgccagggttttcccagtcacgacgttgtaaaacgacggccagtgccaagctgacttggtcagcggccgctctagaactagtggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggccaagctagttttttccctttgttttctgcttttcagtggctgctgcttcgctttcagttccagagagcagcctcagcaaaacgagtgccagatccaaaaactcaatgccctcaaaccggataaccgtatagagtcagaaggagggctcattgagacatggaaccctaacaacaagccattccagtgtgccggtgttgccctctctcgctgcaccctcaaccgcaacgcccttcgtagaccttcctacaccaacggtccccaggaaatctacatccaacaaggtaagggtatttttggcatgatatacccgggttgtcctagcacatttgaagagcctcagcaacctcaacaaagaggacaaagcagcagaccacaagaccgtcaccagaagatctataacttcagagagggtgatttgatcgcagtgcctactggtgttgcatggtggatgtacaacaatgaagacactcctgttgttgccgtttctattattgacaccaacagcttggagaaccagctcgaccagatgcctaggagattctatcttgctgggaaccaagagcaagagtttctaaaatatcagcaagagcaaggaggtcatcaaagccagaaaggaaagcatcagcaagaagaagaaaacgaaggaggcagcatattgagtggcttcaccctggaattcttggaacatgcattcagcgtggacaagcagatagcgaaaaacctacaaggagagaacgaaggggaagacaagggagccattgtgacagtgaaaggaggtctgagcgtgttaaaaccacccacggacgagcagcaacaaagaccccaggaagaggaagaagaagaagaggatgagaagccacagtgcaagggtaaagacaaacactgccaacgcccccgaggaagccaaagcaaaagcagaagaaatggcattgacgagaccatatgcaccatgagacttcgccacaacattggccagacttcatcacctgacatctacaaccctcaagccggtagcgtcacaaccgccaccagccttgacttcccagccctctcgtggctcagactcagtgctgagtttggatctctccgcaagaatgcaatgttcgtgccacactacaacctgaacgcgaacagcataatatacgcattgaatggacgggcattgatacaagtggtgaattgcaacggtgagagagtgtttgatggagagctgcaagagggacgggtgctgatcgtgccacaaaactttgtggtggctgcaagatcacagagtgacaacttcgagtatgtgtcattcaagaccaatgatacacccatgatcggcactcttgcaggggcaaactcattgttgaacgcattaccagaggaagtgattcagcacactttcaacctaaaaagccagcaggccaggcagataaagaacaacaaccctttcaagttcctggttccacctcaggagtctcagaagagagctgtggctggtggtggatctatggctaagattaagtgcacgtggcctgagctggtgggcaagaccgtggagaaagccaagaagatgatcatgaaggacaagccagaggcgaagatcatggttctgccagttgggaccaaagtgaccggtgaatggaagatggatcgcgtccgcctctgggtcgataagaaggacaagatcgccaagactccgaagtgcggctagggtacctctagacatggccacgtgcatgaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggacgactctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctttgctctagactggaattcgtcgacgagctccctatagtgagtcgtattagaggccgacttggccaaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacaaaatattaacgtttacaatttcccattcgccattcaggctgcgcaactgttgggaagggcgat

SEQ ID NO: 44 - DNA, 6472 bp, Artificial Sequence
  plasmid pKS238
ctagactggaattcgtcgacgagctccctatagtgagtcgtattagaggccgacttggccaaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacaaaatattaacgtttacaatttcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagctgacttggtcagcggccgctctagaactagtggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggccaagctagttttttccctttgttttctgcttttcagtggctgctgcttcgctttcagttccagagagcagcctcagcaaaacgagtgccagatccaaaaactcaatgccctcaaaccggataaccgtatagagtcagaaggagggctcattgagacatggaaccctaacaacaagccattccagtgtgccggtgttgccctctctcgctgcaccctcaaccgcaacgcccttcgtagaccttcctacaccaacggtccccaggaaatctacatccaacaaggtaagggtatttttggcatgatatacccgggttgtcctagcacatttgaagagcctcagcaacctcaacaaagaggacaaagcagcagaccacaagaccgtcaccagaagatctataacttcagagagggtgatttgatcgcagtgcctactggtgttgcatggtggatgtacaacaatgaagacactcctgttgttgccgtttctattattgacaccaacagcttggagaaccagctcgaccagatgcctaggagattctatcttgctgggaaccaagagcaagagtttctaaaatatcagcaagagcaaggaggtcatcaaagccagaaaggaaagcatcagcaagaagaagaaaacgaaggaggcagcatattgagtggcttcaccctggaattcttggaacatgcattcagcgtggacaagcagatagcgaaaaacctacaaggagagaacgaaggggaagacaagggagccattgtgacagtgaaaggaggtctgagcgtgttaaaaccacccacggacgagcagcaacaaagaccccaggaagaggaagaagaagaagaggatgagaagccacagtgcaagggtaaagacaaacactgccaacgcccccgaggaagccaaagcaaaagcagaagaaatggcattgacgagaccatatgcaccatgagacttcgccacaacattggccagacttcatcacctgacatctacaaccctcaagccggtagcgtcacaaccgccaccagccttgacttcccagccctctcgtggctcagactcagtgctgagtttggatctctccgcaagaatgcaatgttcgtgccacactacaacctgaacgcgaacagcataatatacgcattgaatggacgggcattgatacaagtggtgaattgcaacggtgagagagtgtttgatggagagctgcaagagggacgggtgctgatcgtgccacaaaactttgtggtggctgcaagatcacagagtgacaacttcgagtatgtgtcattcaagaccaatgatacacccatgatcggcactcttgcaggggcaaactcattgttgaacgcattaccagaggaagtgattcagcacactttcaacctaaaaagccagcaggccaggcagataaagaacaacaaccctttcaagttcctggttccacctcaggagtctcagaagagagctgtggctggtggtggatctatggctaagattaagtgcacgtggcctgagctggtgggcaagaccgtggagaaagccaagaagatgatcatgaaggacaagccagaggcgaagatcatggttctgccagttgggaccaaagtgaccggtgaatggaagatggatcgcgtccgcctctgggtcgataagaaggacaagatcgccaagactccgaagtgcggctagggtacctctagggtggcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagct

SEQ ID NO: 45 - DNA, 6259 bp, Artificial Sequence
  plasmid pKS240
ctctagggtggcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcgtcgacgagctccctatagtgagtcgtattagaggccgacttggccaaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacaaaatattaacgtttacaatttcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagctgacttggtcagcggccgctctagaactagtggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggccaagctagttttttccctttgttttctgcttttcagtggctgctgcttcgctttcagttccagagagcagcctcagcaaaacgagtgccagatccaaaaactcaatgccctcaaaccggataaccgtatagagtcagaaggagggctcattgagacatggaaccctaacaacaagccattccagtgtgccggtgttgccctctctcgctgcaccctcaaccgcaacgcccttcgtagaccttcctacaccaacggtccccaggaaatctacatccaacaaggtaagggtatttttggcatgatatacccgggttgtcctagcacatttgaagagcctcagcaacctcaacaaagaggacaaagcagcagaccacaagaccgtcaccagaagatctataacttcagagagggtgatttgatcgcagtgcctactggtgttgcatggtggatgtacaacaatgaagacactcctgttgttgccgtttctattattgacaccaacagcttggagaaccagctcgaccagatgcctaggagattctatcttgctgggaaccaagagcaagagtttctaaaatatcagcaagagcaaggaggtcatcaaagccagaaaggaaagcatcagcaagaagaagaaaacgaaggaggcagcatattgagtggcttcaccctggaattcttggaacatgcattcagcgtggacaagcagatagcgaaaaacctacaaggagagaacgaaggggaagacaagggagccattgtgacagtgaaaggaggtctgagcgtgttaaaaccacccacggacgagcagcaacaaagaccccaggaagaggaagaagaagaagaggatgagaagccacagtgcaagggtaaagacaaacactgccaacgcccccgaggaagccaaagcaaaagcagaagaaatggcattgacgagaccatatgcaccatgagacttcgccacaacattggccagacttcatcacctgacatctacaaccctcaagccggtagcgtcacaaccgccaccagccttgacttcccagccctctcgtggctcagactcagtgctgagtttggatctctccgcaagaatgcaatgttcgtgccacactacaacctgaacgcgaacagcataatatacgcattgaatggacgggcattgatacaagtggtgaattgcaacggtgagagagtgtttgatggagagctgcaagagggacgggtgctgatcgtgccacaaaactttgtggtggctgcaagatcacagagtgacaacttcgagtatgtgtcattcaagaccaatgatacacccatgatcggcactcttgcaggggcaaactcattgttgaacgcattaccagaggaagtgattcagcacactttcaacctaaaaagccagcaggccaggcagataaagaacaacaaccctttcaagttcctggttccacctcaggagtctcagaagagagctgtggcttagggtac

SEQ ID NO: 46 - DNA, 5267 bp, Artificial Sequence
  plasmid pKS120
atctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcga

SEQ ID NO: 47 - DNA, 8643 bp, Artificial Sequence
  plasmid pKS242
tcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggccaagctagttttttccctttgttttctgcttttcagtggctgctgcttcgctttcagttccagagagcagcctcagcaaaacgagtgccagatccaaaaactcaatgccctcaaaccggataaccgtatagagtcagaaggagggctcattgagacatggaaccctaacaacaagccattccagtgtgccggtgttgccctctctcgctgcaccctcaaccgcaacgcccttcgtagaccttcctacaccaacggtccccaggaaatctacatccaacaaggtaagggtatttttggcatgatatacccgggttgtcctagcacatttgaagagcctcagcaacctcaacaaagaggacaaagcagcagaccacaagaccgtcaccagaagatctataacttcagagagggtgatttgatcgcagtgcctactggtgttgcatggtggatgtacaacaatgaagacactcctgttgttgccgtttctattattgacaccaacagcttggagaaccagctcgaccagatgcctaggagattctatcttgctgggaaccaagagcaagagtttctaaaatatcagcaagagcaaggaggtcatcaaagccagaaaggaaagcatcagcaagaagaagaaaacgaaggaggcagcatattgagtggcttcaccctggaattcttggaacatgcattcagcgtggacaagcagatagcgaaaaacctacaaggagagaacgaaggggaagacaagggagccattgtgacagtgaaaggaggtctgagcgtgttaaaaccacccacggacgagcagcaacaaagaccccaggaagaggaagaagaagaagaggatgagaagccacagtgcaagggtaaagacaaacactgccaacgcccccgaggaagccaaagcaaaagcagaagaaatggcattgacgagaccatatgcaccatgagacttcgccacaacattggccagacttcatcacctgacatctacaaccctcaagccggtagcgtcacaaccgccaccagccttgacttcccagccctctcgtggctcagactcagtgctgagtttggatctctccgcaagaatgcaatgttcgtgccacactacaacctgaacgcgaacagcataatatacgcattgaatggacgggcattgatacaagtggtgaattgcaacggtgagagagtgtttgatggagagctgcaagagggacgggtgctgatcgtgccacaaaactttgtggtggctgcaagatcacagagtgacaacttcgagtatgtgtcattcaagaccaatgatacacccatgatcggcactcttgcaggggcaaactcattgttgaacgcattaccagaggaagtgattcagcacactttcaacctaaaaagccagcaggccaggcagataaagaacaacaaccctttcaagttcctggttccacctcaggagtctcagaagagagctgtggcttagggtacctctagggtggcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcg

SEQ ID NO: 48 - DNA, 8720 bp, Artificial Sequence
  plasmid pKS349
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagc

SEQ ID NO: 49 - DNA, 5280 bp, Artificial Sequence
  plasmid pKS121/BS
  misc_feature (4090)..(4090): n is a, c, g, or t
ggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccactagttctagagcggcgcgccgtcgacggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaagtgtgttattaacccttctcttcgaggatccaagcttggcgcg

SEQ ID NO: 50 - DNA, 5968 bp, Artificial Sequence
  plasmid pDs-Red in pKS121/BS
  misc_feature (5052)..(5052): n is a, c, g, or t
catggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgccgctctagaactagtggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggcccgcgccaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcc

SEQ ID NO: 51 - DNA, 10058 bp, Artificial Sequence
  plasmid pKS332
  misc_feature (1178)..(1178): n is a, c, g, or t
gatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttg

SEQ ID NO: 52 - DNA, 11611 bp, Artificial Sequence
  plasmid pKS362
  misc_feature (2349)..(2349): n is a, c, g, or t
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatctccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 53 - DNA, 1422 bp, Glycine max
ggatccaactaaaaaaagctctcaaattacattttgagttgtttcaggttccattgccttattgctaaaactccaactaaaataacaaatagcacatgcaggtgcaaacaacacgttactctgatgaaggtgatgtgcctctagcagtctagcttatgaggctcgctgcttatcaacgattcatcattccccaagacgtgtacgcagattaaacaatggacaaaacttcaatcgattatagaataataattttaacagtgccgacttttttctgtaaacaaaaggccagaatcatatcgcacatcatcttgaatgcagtgtcgagtttggaccatttgagtacaaagccaatattgaatgatttttcgattttacatgtgtgaatcagacaaaagtgcatgcaatcacttgcaagtaaattaaggatactaatctattcctttcattttatatgctccacttttatataaaaaaatatacattattatatatgcattattaattattgcagtattatgctattggttttatggccctgctaaataacctaaatgagtctaactattgcatatgaatcaaatgaaggaagaatcatgatctaaacctgagtacccaatgcaataaaatgcgtcctattacctaaacttcaaacacacattgccatcggacgtataaattaatgcatatagattattttgagaaaagaaaacatcaaaagctctaaaacttcttttaactttgaaataagctgataaaaatacgctttaaatcaactgtgtgctgtatataagctgcaatttcacattttaccaaaccgaaacaagaatggtaacagtgaggcaaaaatttgaaaaatgtcctacttcacattcacatcaaattaattacaactaaataaataaacatcgtgattcaagcagtaatgaaagtcgaaatcagatagaatatacacgtttaacatcaattgaatttttttttaaatggatatatacaagtttactattttatatataatgaaaattcattttgtgttagcacaaaacttacagaaagagataaattttaaataaagagaattatatccaattttataatccaaaataatcaaattaaagaatattggctagatagaccggctttttcactgcccctgctggataatgaaaattcatatcaaaacaatacagaagttctagtttaataataaaaaagttggcaaactgtcattccctgttggtttttaagccaaatcacaattcaattacgtatcagaaattaatttaaaccaaatatatagctacgagggaacttcttcagtcattactagctagctcactaatcactatatatacgacatgctacaagtgaagtgaccatatcttaatttcaaatcataaaattcttccaccaagttgcggccgc

SEQ ID NO: 54 - DNA, 41 bp, Artificial Sequence
  primer oP34-1
cgcggatccaactaaaaaaagctctcaaattacattttgag

SEQ ID NO: 55 - DNA, 44 bp, Artificial Sequence
  primer oP34-2
gaattcgcggccgcaacttggtggaagaattttatgatttgaaa

SEQ ID NO: 56 - DNA, 7466 bp, Artificial Sequence
  plasmid pZBL115
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgctctagcccggccgcctccagctttctttcctccctgcattttcaaagatcaattatttcctttctttgtttctcacttaggttctttcttctttcaacagcacaccgcatgctaccaaataaatagatttaggtgcggcgctatcttttgcacacgtgtcagtgcagtacgcgtggcaagtttctgaggattattggactaatcgtcttacacgtaattgccgcgtgtctgtttgcaacgagcttcaacacagtgttagggacacgtggcaatcaaccactcgtgcaataggggcttacataaacggtcgattaatctaattggggatgaaattgacttctcttatcccttccaaattgtctctccgttatcccttccaaatgatgttaagatttgtattaatatttaaaatgatatcattttgaaagaataatttgaaaaaggataataaaaagttaaatcaaatgcgaaatatactaaaagttattgattaaagttattgattaaaattattgctaatcatctctcaactctcaaatgtttctctttaattctatgcaacttaagctctaattaatagcacttactagtagttagaggcagataaaaacatgaagaaaaaaaaaactttctttatcaattgatacaagaatatgatcctttatttatattaaagtggaagtgacatttagcctatcgcacgtagtgttgaaccattcctcaattgaaagagaatgtgaagggtgaattgaaaagaaaaaagagagatggaaaggaagaatttgaaatagagatagaacaacaaagtttagctctttgccttcgtacatatattttaaaaatattatttttcagtacaaaaatcgcaataatgtcacactatgatttatgtatgacattgttgtaagttggtgtggcgtaagtacttgattaaattatttatcaaatgcaatttgcaaaacaattttgaatgaatttgtttaaaaagtattgctgttaaattttttatcttagaagaattgagggatcgggcg

SEQ ID NO: 57 - DNA, 7841 bp, Artificial Sequence
  plasmid pJS89
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcaacttggtggaagaattttatgatttgaaattaagatatggtcacttcacttgtagcatgtcgtatatatagtgattagtgagctagctagtaatgactgaagaagttccctcgtagctatatatttggtttaaattaatttctgatacgtaattgaattgtgatttggcttaaaaaccaacagggaatgacagtttgccaacttttttattattaaactagaacttctgtattgttttgatatgaattttcattatccagcaggggcagtgaaaaagccggtctatctagccaatattctttaatttgattattttggattataaaattggatataattctctttatttaaaatttatctctttctgtaagttttgtgctaacacaaaatgaattttcattatatataaaatagtaaacttgtatatatccatttaaaaaaaaattcaattgatgttaaacgtgtatattctatctgatttcgactttcattactgcttgaatcacgatgtttatttatttagttgtaattaatttgatgtgaatgtgaagtaggacatttttcaaatttttgcctcactgttaccattcttgtttcggtttggtaaaatgtgaaattgcagcttatatacagcacacagttgatttaaagcgtatttttatcagcttatttcaaagttaaaagaagttttagagcttttgatgttttcttttctcaaaataatctatatgcattaatttatacgtccgatggcaatgtgtgtttgaagtttaggtaataggacgcattttattgcattgggtactcaggtttagatcatgattcttccttcatttgattcatatgcaatagttagactcatttaggttatttagcagggccataaaaccaatagcataatactgcaataattaataatgcatatataataatgtatatttttttatataaaagtggagcatataaaatgaaaggaatagattagtatccttaatttacttgcaagtgattgcatgcacttttgtctgattcacacatgtaaaatcgaaaaatcattcaatattggctttgtactcaaatggtccaaactcgacactgcattcaagatgatgtgcgatatgattctggccttttgtttacagaaaaaagtcggcactgttaaaattattattctataatcgattgaagttttgtccattgtttaatctgcgtacacgtcttggggaatgatgaatcgttgataagcagcgagcctcataagctagactgctagaggcacatcaccttcatcagagtaacgtgttgtttgcacctgcatgtgctatttgttattttagttggagttttagcaataaggcaatggaacctgaaacaactcaaaatgtaatttgagagctttttttagttg

SEQ ID NO: 58 - DNA, 1390 bp, Morteriella alpina
gcggccgcatggctgctgctcccagtgtgaggacgtttactcgggccgaggttttgaatgccgaggctctgaatgagggcaagaaggatgccgaggcacccttcttgatgatcatcgacaacaaggtgtacgatgtccgcgagttcgtccctgatcatcccggtggaagtgtgattctcacgcacgttggcaaggacggcactgacgtctttgacacttttcaccccgaggctgcttgggagactcttgccaacttttacgttggtgatattgacgagagcgaccgcgatatcaagaatgatgactttgcggccgaggtccgcaagctgcgtaccttgttccagtctcttggttactacgattcttccaaggcatactacgccttcaaggtctcgttcaacctctgcatctggggtttgtcgacggtcattgtggccaagtggggccagacctcgaccctcgccaacgtgctctcggctgcgcttttgggtctgttctggcagcagtgcggatggttggctcacgactttttgcatcaccaggtcttccaggaccgtttctggggtgatcttttcggcgccttcttgggaggtgtctgccagggcttctcgtcctcgtggtggaaggacaagcacaacactcaccacgccgcccccaacgtccacggcgaggatcccgacattgacacccaccctctgttgacctggagtgagcatgcgttggagatgttctcggatgtcccagatgaggagctgacccgcatgtggtcgcgtttcatggtcctgaaccagacctggttttacttccccattctctcgtttgcccgtctctcctggtgcctccagtccattctctttgtgctgcctaacggtcaggcccacaagccctcgggcgcgcgtgtgcccatctcgttggtcgagcagctgtcgcttgcgatgcactggacctggtacctcgccaccatgttcctgttcatcaaggatcccgtcaacatgctggtgtactttttggtgtcgcaggcggtgtgcggaaacttgttggcgatcgtgttctcgctcaaccacaacggtatgcctgtgatctcgaaggaggaggcggtcgatatggatttcttcacgaagcagatcatcacgggtcgtgatgtccacccgggtctatttgccaactggttcacgggtggattgaactatcagatcgagcaccacttgttcccttcgatgcctcgccacaacttttcaaagatccagcctgctgtcgagaccctgtgcaaaaagtacaatgtccgataccacaccaccggtatgatcgagggaactgcagaggtctttagccgtctgaacgaggtctccaaggctgcctccaagatgggtaaggcgcagtaagcggccgc

SEQ ID NO: 59 - DNA, 9223 bp, Artificial Sequence
  plasmid pJS93
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttgttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttgcggccgcttactgcgccttacccatcttggaggcagccttggagacctcgttcagacggctaaagacctctgcagttccctcgatcataccggtggtgtggtatcggacattgtactttttgcacagggtctcgacagcaggctggatctttgaaaagttgtggcgaggcatcgaagggaacaagtggtgctcgatctgatagttcaatccacccgtgaaccagttggcaaatagacccgggtggacatcacgacccgtgatgatctgcttcgtgaagaaatccatatcgaccgcctcctccttcgagatcacaggcataccgttgtggttgagcgagaacacgatcgccaacaagtttccgcacaccgcctgcgacaccaaaaagtacaccagcatgttgacgggatccttgatgaacaggaacatggtggcgaggtaccaggtccagtgcatcgcaagcgacagctgctcgaccaacgagatgggcacacgcgcgcccgagggcttgtgggcctgaccgttaggcagcacaaagagaatggactggaggcaccaggagagacgggcaaacgagagaatggggaagtaaaaccaggtctggttcaggaccatgaaacgcgaccacatgcgggtcagctcctcatctgggacatccgagaacatctccaacgcatgctcactccaggtcaacagagggtgggtgtcaatgtcgggatcctcgccgtggacgttgggggcggcgtggtgagtgttgtgcttgtccttccaccacgaggacgagaagccctggcagacacctcccaagaaggcgccgaaaagatcaccccagaaacggtcctggaagacctggtgatgcaaaaagtcgtgagccaaccatccgcactgctgccagaacagacccaaaagcgcagccgagagcacgttggcgagggtcgaggtctggccccacttggccacaatgaccgtcgacaaaccccagatgcagaggttgaacgagaccttgaaggcgtagtatgccttggaagaatcgtagtaaccaagagactggaacaaggtacgcagcttgcggacctcggccgcaaagtcatcattcttgatatcgcggtcgctctcgtcaatatcaccaacgtaaaagttggcaagagtctcccaagcagcctcggggtgaaaagtgtcaaagacgtcagtgccgtccttgccaacgtgcgtgagaatcacacttccaccgggatgatcagggacgaactcgcggacatcgtacaccttgttgtcgatgatcatcaagaagggtgcctcggcatccttcttgccctcattcagagcctcggcattcaaaacctcggcccgagtaaacgtcctcacactgggagcagcagccatgcggccgcaacttggtggaagaattttatgatttgaaattaagatatggtcacttcacttgtagcatgtcgtatatatagtgattagtgagctagctagtaatgactgaagaagttccctcgtagctatatatttggtttaaattaatttctgatacgtaattgaattgtgatttggcttaaaaaccaacagggaatgacagtttgccaacttttttattattaaactagaacttctgtattgttttgatatgaattttcattatccagcaggggcagtgaaaaagccggtctatctagccaatattctttaatttgattattttggattataaaattggatataattctctttatttaaaatttatctctttctgtaagttttgtgctaacacaaaatgaattttcattatatataaaatagtaaacttgtatatatccatttaaaaaaaaattcaattgatgttaaacgtgtatattctatctgatttcgactttcattactgcttgaatcacgatgtttatttatttagttgtaattaatttgatgtgaatgtgaagtaggacatttttcaaatttttgcctcactgttaccattcttgtttcggtttggtaaaatgtgaaattgcagcttatatacagcacacagttgatttaaagcgtatttttatcagcttatttcaaagttaaaagaagttttagagcttttgatgttttcttttctcaaaataatctatatgcattaatttatacgtccgatggcaatgtgtgtttgaagtttaggtaataggacgcattttattgcattgggtactcaggtttagatcatgattcttccttcatttgattcatatgcaatagttagactcatttaggttatttagcagggccataaaaccaatagcataatactgcaataattaataatgcatatataataatgtatatttttttatataaaagtggagcatataaaatgaaaggaatagattagtatccttaatttacttgcaagtgattgcatgcacttttgtctgattcacacatgtaaaatcgaaaaatcattcaatattggctttgtactcaaatggtccaaactcgacactgcattcaagatgatgtgcgatatgattctggccttttgtttacagaaaaaagtcggcactgttaaaattattattctataatcgattgaagttttgtccattgtttaatctgcgtacacgtcttggggaatgatgaatcgttgataagcagcgagcctcataagctagactgctagaggcacatcaccttcatcagagtaacgtgttgtttgcacctgcatgtgctatttgttattttagttggagttttagcaataaggcaatggaacctgaaacaactcaaaatgtaatttgagagctttttttagttg

SEQ ID NO: 60 - DNA, 7472 bp, Artificial Sequence
  plasmid pKS127
gatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatccgttgaaacatccctgaagtgtctcattttattttatttattctttgctgataaaaaaataaaataaaagaagctaagcacacggtcaaccattgctttactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtcctccttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacgtgcattttagttcatacttgcggccgctctagcccggccgcctccagctttctttcctccctgcattttcaaagatcaattatttcctttctttgtttctcacttaggttctttcttctttcaacagcacaccgcatgctaccaaataaatagatttaggtgcggcgctatcttttgcacacgtgtcagtgcagtacgcgtggcaagtttctgaggattattggactaatcgtcttacacgtaattgccgcgtgtctgtttgcaacgagcttcaacacagtgttagggacacgtggcaatcaaccactcgtgcaataggggcttacataaacggtcgattaatctaattggggatgaaattgacttctcttatcccttccaaattgtctctccgttatcccttccaaatgatgttaagatttgtattaatatttaaaatgatatcattttgaaagaataatttgaaaaaggataataaaaagttaaatcaaatgcgaaatatactaaaagttattgattaaagttattgattaaaattattgctaatcatctctcaactctcaaatgtttctctttaattctatgcaacttaagctctaattaatagcacttactagtagttagaggcagataaaaacatgaagaaaaaaaaaactttctttatcaattgatacaagaatatgatcctttatttatattaaagtggaagtgacatttagcctatcgcacgtagtgttgaaccattcctcaattgaaagagaatgtgaagggtgaattgaaaagaaaaaagagagatggaaaggaagaatttgaaatagagatagaacaacaaagtttagctctttgccttcgtacatatattttaaaaatattatttttcagtacaaaaatcgcaataatgtcacactatgatttatgtatgacattgttgtaagttggtgtggcgtaagtacttgattaaattatttatcaaatgcaatttgcaaaacaattttgaatgaatttgtttaaaaagtattgctgttaaattttttatcttagaagaattgagggatcgggcg

SEQ ID NO: 61 - DNA, 7847 bp, Artificial Sequence
  plasmid pKS343
ggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatccaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccaactaaaaaaagctctcaaattacattttgagttgtttcaggttccattgccttattgctaaaactccaactaaaataacaaatagcacatgcaggtgcaaacaacacgttactctgatgaaggtgatgtgcctctagcagtctagcttatgaggctcgctgcttatcaacgattcatcattccccaagacgtgtacgcagattaaacaatggacaaaacttcaatcgattatagaataataattttaacagtgccgacttttttctgtaaacaaaaggccagaatcatatcgcacatcatcttgaatgcagtgtcgagtttggaccatttgagtacaaagccaatattgaatgatttttcgattttacatgtgtgaatcagacaaaagtgcatgcaatcacttgcaagtaaattaaggatactaatctattcctttcattttatatgctccacttttatataaaaaaatatacattattatatatgcattattaattattgcagtattatgctattggttttatggccctgctaaataacctaaatgagtctaactattgcatatgaatcaaatgaaggaagaatcatgatctaaacctgagtacccaatgcaataaaatgcgtcctattacctaaacttcaaacacacattgccatcggacgtataaattaatgcatatagattattttgagaaaagaaaacatcaaaagctctaaaacttcttttaactttgaaataagctgataaaaatacgctttaaatcaactgtgtgctgtatataagctgcaatttcacattttaccaaaccgaaacaagaatggtaacagtgaggcaaaaatttgaaaaatgtcctacttcacattcacatcaaattaattacaactaaataaataaacatcgtgattcaagcagtaatgaaagtcgaaatcagatagaatatacacgtttaacatcaattgaatttttttttaaatggatatatacaagtttactattttatatataatgaaaattcattttgtgttagcacaaaacttacagaaagagataaattttaaataaagagaattatatccaattttataatccaaaataatcaaattaaagaatattggctagatagaccggctttttcactgcccctgctggataatgaaaattcatatcaaaacaatacagaagttctagtttaataataaaaaagttggcaaactgtcattccctgttggtttttaagccaaatcacaattcaattacgtatcagaaattaatttaaaccaaatatatagctacgagggaacttcttcagtcattactagctagctcactaatcactatatatacgacatgctacaagtgaagtgaccatatcttaatttcaaatcataaaattcttccaccaagttgc

SEQ ID NO: 62 - DNA, 10866 bp, Artificial Sequence
  plasmid pKS352
  misc_feature (9689)..(9689): n is a, c, g, or t
agcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcagattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccaactaaaaaaagctctcaaattacattttgagttgtttcaggttccattgccttattgctaaaactccaactaaaataacaaatagcacatgcaggtgcaaacaacacgttactctgatgaaggtgatgtgcctctagcagtctagcttatgaggctcgctgcttatcaacgattcatcattccccaagacgtgtacgcagattaaacaatggacaaaacttcaatcgattatagaataataattttaacagtgccgacttttttctgtaaacaaaaggccagaatcatatcgcacatcatcttgaatgcagtgtcgagtttggaccatttgagtacaaagccaatattgaatgatttttcgattttacatgtgtgaatcagacaaaagtgcatgcaatcacttgcaagtaaattaaggatactaatctattcctttcattttatatgctccacttttatataaaaaaatatacattattatatatgcattattaattattgcagtattatgctattggttttatggccctgctaaataacctaaatgagtctaactattgcatatgaatcaaatgaaggaagaatcatgatctaaacctgagtacccaatgcaataaaatgcgtcctattacctaaacttcaaacacacattgccatcggacgtataaattaatgcatatagattattttgagaaaagaaaacatcaaaagctctaaaacttcttttaactttgaaataagctgataaaaatacgctttaaatcaactgtgtgctgtatataagctgcaatttcacattttaccaaaccgaaacaagaatggtaacagtgaggcaaaaatttgaaaaatgtcctacttcacattcacatcaaattaattacaactaaataaataaacatcgtgattcaagcagtaatgaaagtcgaaatcagatagaatatacacgtttaacatcaattgaatttttttttaaatggatatatacaagtttactattttatatataatgaaaattcattttgtgttagcacaaaacttacagaaagagataaattttaaataaagagaattatatccaattttataatccaaaataatcaaattaaagaatattggctagatagaccggctttttcactgcccctgctggataatgaaaattcatatcaaaacaatacagaagttctagtttaataataaaaaagttggcaaactgtcattccctgttggtttttaagccaaatcacaattcaattacgtatcagaaattaatttaaaccaaatatatagctacgagggaacttcttcagtcattactagctagctcactaatcactatatatacgacatgctacaagtgaagtgaccatatcttaatttcaaatcataaaattcttccaccaagttgcggccgcaagtatgaactaaaatgcacgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaaggaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtaaagcaatggttgaccgtgtgcttagcttcttttattttatttttttatcagcaaagaataaataaaataaaatgagacacttcagggatgtttcaacggatccaagctgatccactagttctagagcggcccgcgccgtcgacggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccggccgctacaggaacaggtggtggcggccctcggcgcgctcgtactgctccacgatggtgtagtcctcgttgtgggaggtgatgtccagcttggagtccacgtagtagtagccgggcagctgcacgggcttcttggccatgtagatggacttgaactccaccaggtagtggccgccgtccttcagcttcagggccttgtggatctcgcccttcagcacgccgtcgcgggggtacaggcgctcggtggaggcctcccagcccatagtcttcttctgcattacggggccgtcggaggggaagttcacgccgatgaacttcaccttgtagatgaaggagccgtcctgcagggaggagtcctgggtcacggtcaccacgccgccgtcctcgaagttcatcacgcgctcccacttgaagccctcggggaaggacagcttcttgtagtcggggatgtcggcggggtgcttcacgtacaccttggagccgtactggaactggggggacaggatgtcccaggcgaagggcagggggccgcccttggtcaccttcagcttggcggtctgggtgccctcgtaggggcggccctcgccctcgccctcgatctcgaactcgtggccgttcacggagccctccatgcgcaccttgaagcgcatgaactccttgatgacgtcctcggaggaggccatgggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaagtgtgttattaacccttctcttcgaggatc

SEQ ID NO: 63 - DNA, 12055 bp, Artificial Sequence
  plasmid pKS364
agcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatctccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctctagactggaattcgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgcca

SEQ ID NO: 64 - DNA, 1581 bp, Yarrowia lipolytica
atggaggtgcgcagacgcaagattgacgttctcaaggcccagaagaatggttacgagtccggcccaccatctagacagtcctctcagccatcctctagagcctcctccagaacacgcaacaagcactcctcctccacactttccctttccggcctcaccatgaaggtgcagaagaagccagctggtccaccagccaactccaagaccccattcctccacatcaagccagtgcacacttgctgctccacctcaatgctctccagagactacgacggctccaacccatccttcaagggcttcaagaacatcggcatgatcatcctcatcgtgggcaatcttcgcctcgccttcgagaactacctcaagtacggcatctccaaccccttcttcgaccccaagatcacaccctccgagtggcagctttctggacttctcatcgttgtggcttacgctcacatcctcatggcttacgctatcgagtccgctgccaagctcctcttcctctcctccaagcaccactacatggccgttggtctcctccacaccatgaacaccctctcctccatttccctcctctcctacgtggtgtactactacctccccaatccagtggctggcactatcgttgagttcgtggccgtgatcctttctctcaagctcgcttcctacgcccttaccaactccgatctcagaaaggctgccattcacgcccagaagctcgacaagacacaggacgacaacgagaaggagtccacctcctcttcctcttcctctgacgacgccgagacacttgccgacatcgacgttatcccagcttactacgctcagcttccctacccacagaacgttaccctctccaacctcctctacttctggttcgctcccacccttgtgtaccagcccgtttacccaaagacagagagaatccgccccaagcatgtgatccgcaacctcttcgagcttgtgtctctctgcatgctcatccagttcctcatcttccagtacgcctaccccatcatgcagtcttgccttgccctcttcttccagccaaagctcgactacgccaacatttccgagcgcctcatgaagctcgcctctgtgtccatgatggtgtggctcatcggtttctacgccttcttccagaacggtctcaacctcatcgccgagctcacctgcttcggtaaccgcacattctaccagcagtggtggaactccagatctattggccagtactggacactctggaacaagcccgtgaaccagtacttccgccatcacgtttacgttcctcttctcgctaggggcatgtccagattcaacgcctctgttgtggtgttcttcttctccgctgtgattcacgagctccttgtgggcattcccacacacaacatcatcggcgctgccttcttcggaatgatgtcccaggtgccacttatcatggccaccgagaaccttcagcacatcaactcctcccttggcccattccttggtaactgcgctttctggttcaccttcttccttggtcagcctacctgcgcctttctctactaccttgcctacaactacaagcagaaccagtag

SEQ ID NO: 65 - protein, 526 aa, Yarrowia lipolytica
MEVRRRKIDVLKAQKNGYESGPPSRQSSQPSSRASSRTRNKHSSSTLSLSGLTMKVQKKPAGPPANSKTPFLHIKPVHTCCSTSMLSRDYDGSNPSFKGFKNIGMIILIVGNLRLAFENYLKYGISNPFFDPKITPSEWQLSGLLIVVAYAHILMAYAIESAAKLLFLSSKHHYMAVGLLHTMNTLSSISLLSYVVYYYLPNPVAGTIVEFVAVILSLKLASYALTNSDLRKAAIHAQKLDKTQDDNEKESTSSSSSSDDAETLADIDVIPAYYAQLPYPQNVTLSNLLYFWFAPTLVYQPVYPKTERIRPKHVIRNLFELVSLCMLIQFLIFQYAYPIMQSCLALFFQPKLDYANISERLMKLASVSMMVWLIGFYAFFQNGLNLIAELTCFGNRTFYQQWWNSRSIGQYWTLWNKPVNQYFRHHVYVPLLARGMSRFNASVVVFFFSAVIHELLVGIPTHNIIGAAFFGMMSQVPLIMATENLQHINSSLGPFLGNCAFWFTFFLGQPTCAFLYYLAYNYKQNQ

SEQ ID NO: 66 - DNA, 1545 bp, Yarrowia lipolytica
atgaccatcgactcccagtactacaagtcccgcgacaagaacgacaccgctcccaagattgctggtatccgctacgctcctctgtctactccactcttgaaccgctgcgagactttctctttggtgtggcacatcttctccatccctaccttcctcaccatcttcatgctctgctgtgccattcccttgctctggcccttcgtgatcgcttacgttgtgtacgccgtgaaggatgactccccttccaacggcggtgttgtgaagcgctattcccctatctcccgcaacttcttcatctggaagctctttggccgctacttccccatcaccctccacaagaccgttgatttggagcccacccacacttactatcccttggacgtccaagagtaccacctgattgctgagcgctattggcctcagaacaagtacctgcgcgccatcattaccaccatcgagtacttcctgcccgctttcatgaagcgttccctctccatcaacgagcaggagcagcctgctgagagagaccctctgttgtctcccgtttccccctcttctcctggttctcagcccgacaagtggatcaaccatgattcccgctattccagaggtgagtcctctggctccaatggtcatgcttctggctctgaactgaatggcaatggcaacaacggcactaccaatcgccgccctctttcttctgcttccgctggctctactgcttctgactctaccttgctcaacggctctctcaactcctacgccaaccagatcattggcgagaacgaccctcagttgtctcccactaagctcaagcctactggcaggaagtacatcttcgggtaccatcctcacggtatcattgggatgggcgcctttggtggcattgctactgaaggtgctggctggtccaagctctttcctggtatccccgtttccctcatgaccctcaccaacaactttcgcgttcctctctatcgcgagtacctcatgtccctgggcgttgcttccgtttctaagaagtcctgtaaggccctcctcaagcgtaatcagtccatctgcatcgtggtgggtggtgcccaggaatccttgttggctaggcctggtgttatggatctcgtgttgctgaagcgcaagggttttgtgcgcttgggtatggaggtgggcaatgttgccctcgttccaatcatggctttcggcgagaacgatctctacgaccaggtgtccaacgacaagtcctccaagctgtaccgcttccagcagttcgtgaagaacttcctcggcttcaccctccctctcatgcatgccagaggtgtgttcaactacgatgttgggctcgttccctaccgccgccctgtgaacattgtggttggttctcctatcgacttgccttacctccctcatcccaccgatgaggaagtttccgagtaccacgaccgttacatcgctgagctccagcgcatctacaacgagcacaaggacgagtacttcatcgactggactgaggagggtaagggcgctcctgagtttcgtatgatcgagtag

SEQ ID NO: 67 - protein, 514 aa, Yarrowia lipolytica; identical to SEQ ID NO: 10

SEQ ID NO: 68 - DNA, 8638 bp, Artificial Sequence
  plasmid pKR1234
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 69 - DNA, 21 bp, Artificial Sequence
  primer oSGly-2
aagcggccgcggtgatgactg

SEQ ID NO: 70 - DNA, 32 bp, Artificial Sequence
  primer oSGly-3
taagcttcgtacgctagcctaagtacgtactc

SEQ ID NO: 71 - DNA, 3673 bp, Artificial Sequence
  plasmid pPSgly32
gggctagagcggccgccaccgcggtggagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggggatccgccctaagcttcgtacgctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgctt

SEQ ID NO: 72 - DNA, 4171 bp, Artificial Sequence
  plasmid pKR264
gcccgggggatccgccctaagcttcgtacgctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgca

SEQ ID NO: 73 - DNA, 6130 bp, Artificial Sequence
  plasmid pKR1212
ctagaggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaaaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagct

SEQ ID NO: 74 - DNA, 5764 bp, Artificial Sequence
  plasmid pKR1235
ggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcacgtacgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcagcccgggggatccgccctaagcttcgtacgctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaaaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagc

SEQ ID NO: 75 - DNA, 11693 bp, Artificial Sequence
  plasmid pKR1236
gtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgtgaaggttaaacatggtgaatatgttaccactagctgggatgcccattagatcaaaactgtaaaattctcccgtttcccttctattcacatgtgagccccctcccttttctttctttctcaattttgattgagttaaagtcaccagcaatgcatcactcaccctccaaaaaatttcttgtacaacttctcggactatcccaaagctccttttcctgagatggatggtcctgtctcttgcccttgatgtcttccttgttcgattttggcttcctctaatgtctttcttgctaggaatcaccacctcactcatctatgttgtcgtagcttctgaaagtctcatacatatccttagtgttgcactcatcttgtattgaagtgaaaaagaatgttgttctcctatccaaatctccattgaatctctttctcccaatgttgtcccatcggttggtcctcctctccaaccaattgtaaggtgtttaacataaacatggtacaattaagatttttcatttcattaagaaaagattgagatttgtggttctaaagtttcaattagagtttgatgatattgaaacaaccgtagaacacattaagtattactaacttatacatagagcattggaatttcaccttttatttattctgtttccgccaaaggtacatgactcaagttattttacacaagtaacaaaggcatctaagcctaagtattcttattcagacttttcattattactttcattgatttggtgcgaaatgcggccgctactggttctgcttgtagttgtaggccaaatagtaaaggaatgcacaagtgggttgtcccaggaaaaaggtgaaccagaatgcacagttgccaaggaaggggcccagagaggagttaatatgctgaaggttctcagtagccatgatcagaggcacctgcgacatcatgccgaagaaggcggctccgatgatgttgtgagtggggatgccgacaagcagttcatggatgacggcggagaaaaagaaaaccaccaccgacgcattgaaccgcgacatgccccgagcgagaagaggcacgtagacgtggtgtctaaagtactggttgactggcttgttccatagagtccagtactggccaatggagcgggaattccaccactgctggtagaaggttctgtttccaaaacaggtgagctcggcaataagattgagaccgttctggaagaaagcgtagaatccaatgagccagaccatcatagacacggaggccaacttcatgaggcgctcggagatgttggcataatcgagcttgggctggaagaacagagccagacacgactgcatgatggggtaggcgtactggaagatgagaaactgaataagcatgcacagagagacgagctcaaacaggtttcggatcacgtgcttgggtcgaatacgctccgtcttggggtacacgggctggtagaccagtgtgggagcaaaccagaagtacagcaggttcgacagcgtcacattctgggggtagggcagctgtgcgtagtatgcaggaatgacgtcaatgtctgccaaagtctctgcgtcatctgaagaagaggaagacgaggtggattccttttcgttatcgtcttgcgtcttgtcgagcttctgggcatgaattgcggcttttcggagatccgagttagtgagggcgtatgaggcgagtttgagagacagaataacggccacaaactcgactattgtgcctgccacggggttgggcaggtagtagtagacgacgtaggacagcaacgagatggacgacaaagtgttcatggtatgcagaagccccacggccatgtagtggtgtttgctagagaggaacagcagcttggcagcgctctcaatagcgtaggccatgaggatatgtgcgtaggccacgactatgagcaagcctgagagctgccactcggaaggagtaattttggggtcgaagaacgggttggaaatgccgtatttgaggtagttttcgaatgcgagccgtagatttcccacaatgagaatgatcatgccgatgtttttgaagcccttgaagctggggttggagccgtcataatcgcgcgaaagcattgatgtggagcagcacgtgtgcacgggcttgatgtgtaggaatggcgttttggagttcgccgggggtcccgcaggtttcttctggactttcatggtcagtccgctgagcgacagggtggacgaggagtgtttgttgcgggttctggacgatgctcttgaggagggctgcgacgattgtcgagatggtgggcccgattcgtagccgtttttctgggccttgagcacgtctatctttcgtcgtcggacctccatggtttgcggccgcggtgatgactgatgagtgtttaaggaccaatggagagaatgtttgagttgtgaagcggagaacctgaggcgtggttatttatagggaagagaggaaggtgaatgagggacacgtcacagaagtagggtgctgagcttgagacattcttcagtatgcatggctatggaagccttgggtgctacacctcatgaagttcatggtgtgaggtggcttcggcatctcaattaagtgacaaagagaaaggtgtttcagtgtttctattgcaaatggcagaaactcgtgatgacgaggggaccatgcatggtttcatttcttttcttcctggattctttctttccttttatatatgcaggttcataatttaaaaattagactcgctttcaatttcttaatttctcattttcctcttatattactgtactaatgttaaccacgtacacttattttttttttagtttaattttgatagattgtgttgatttaaacatattaatattttcaaccaaataaaaatcattttagtagatacggctttttaaataattattaaaaatattaactatttatcctaaatggcacattttaattaaaaaaaatccggtgttgtaagtgttttattaatttgttttggcattattaaagcaactttttttttatttgttggcattttgagtacgtacttaggctagc

SEQ ID NO: 76 - DNA, 34 bp, Artificial Sequence
  primer oYDG2-1
agcggccgcaacatgactatcgactcacaatact

SEQ ID NO: 77 - DNA, 25 bp, Artificial Sequence
  primer oYDG2-2
tgcggccgcttactcaatcattcgg

SEQ ID NO: 78 - DNA, 5079 bp, Artificial Sequence
  plasmid pKR1254
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcacctg

SEQ ID NO: 79 - DNA, 34 bp, Artificial Sequence
  primer YlD2_Y326F-5
cttccgagtgcctctcttcagagagtacctcatg

SEQ ID NO: 80 - DNA, 34 bp, Artificial Sequence
  primer YlD2_Y326F-3
catgaggtactctctgaagagaggcactcggaag

SEQ ID NO: 81 - DNA, 5079 bp, Artificial Sequence
  plasmid pKR1254_Y326F
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcacctg

SEQ ID NO: 82 - DNA, 1545 bp, Yarrowia lipolytica
atgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaa

SEQ ID NO: 83 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIITTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLFREYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 84 - DNA, 34 bp, Artificial Sequence
  primer YlD2_Y326L-5
cttccgagtgcctctcctcagagagtacctcatg

SEQ ID NO: 85 - DNA, 34 bp, Artificial Sequence
  primer YlD2_Y326L-3
catgaggtactctctgaggagaggcactcggaag

SEQ ID NO: 86 - DNA, 5079 bp, Artificial Sequence
  plasmid pKR1254_Y326L
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcctcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcacctg

SEQ ID NO: 87 - DNA, 1545 bp, Yarrowia lipolytica
atgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcctcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaa

SEQ ID NO: 88 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIITTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLLREYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 89 - DNA, 35 bp, Artificial Sequence
  primer YlD2_R327K-5
ccgagtgcctctctacaaagagtacctcatgagtc

SEQ ID NO: 90 - DNA, 35 bp, Artificial Sequence
  primer YlD2_R327K-3
gactcatgaggtactctttgtagagaggcactcgg

SEQ ID NO: 91 - DNA, 5079 bp, Artificial Sequence
  plasmid pKR1254_R327K
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacaaagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagcggccgcacctg

SEQ ID NO: 92 - DNA, 1545 bp, Yarrowia lipolytica
atgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacaaagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaa

SEQ ID NO: 93 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIITTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLYKEYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 94 - DNA, 9074 bp, Artificial Sequence
  plasmid pY191
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 95 - DNA, 9074 bp, Artificial Sequence
  plasmid pY192
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 96 - DNA, 9074 bp, Artificial Sequence
  plasmid pY193
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcctcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 97 - DNA, 9074 bp, Artificial Sequence
  plasmid pY194
ggccgcagggcggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatcgacggtcgaggagaacttctagtatatccacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagaggccggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatttcaaggatataccattctaatgtctgcccctatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtggctggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatcttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggttgaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccaccgaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatagtaaaggaatacaggtaagcaaattgatactaatggctcaacgtgataaggaaaaagaattgcactttaacattaatattgacaaggaggagggcaccacacaaaaagttaggtgtaacagaaaatcatgaaactacgattcctaatttgatattggaggattttctctaaaaaaaaaaaaatacaacaaataaaaaacactcaatgacctgaccatttgatggagtttaagtcaataccttcttgaagcatttcccataatggtgaaagttccctcaagaattttactctgtcagaaacggccttacgacgtagtcgatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacattttttatgtttatctctagtattactctttagacaaaaaaattgtagtaagaactattcatagagtgaatcgaaaacaatacgaaaatgtaaacatttcctatacgtagtatatagagacaaaatagaagaaaccgttcataattttctgaccaatgaagaatcatcaacgctatcactttctgttcacaaagtatgcgcaatccacatcggtatagaatataatcggggatgcctttatcttgaaaaaatgcacccgcagcttcgctagtaatcagtaaacgcgggaagtggagtcaggctttttttatggaagagaaaatagacaccaaagtagccttcttctaaccttaacggacctacagtgcaaaaagttatcaagagactgcattatagagcgcacaaaggagaaaaaaagtaatctaagatgctttgttagaaaaatagcgctctcgggatgcatttttgtagaacaaaaaagaagtatagattctttgttggtaaaatagcgctctcgcgttgcatttctgttctgtaaaaatgcagctcagattctttgtttgaaaaattagcgctctcgcgttgcatttttgttttacaaaaatgaagcacagattcttcgttggtaaaatagcgctttcgcgttgcatttctgttctgtaaaaatgcagctcagattctttgtttgaaaaattagcgctctcgcgttgcatttttgttctacaaaatgaagcacagatgcttcgttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagcgcgcaattaaccctcactaaagggaacaaaagctggagctccaccgcgggatttcgaaactaagttcttggtgttttaaaactaaaaaaaagactaactataaaagtagaatttaagaagtttaagaaatagatttacagaattacaatcaatacctaccgtctttatatacttattagtcaagtaggggaataatttcagggaactggtttcaaccttttttttcagctttttccaaatcagagagagcagaaggtaatagaaggtgtaagaaaatgagatagatacatgcgtgggtcaattgccttgtgtcatcatttactccaggcaggttgcatcactccattgaggttgtgcccgttttttgcctgtttgtgcccctgttctctgtagttgcgctaagagaatggacctatgaactgatggttggtgaagaaaacaatattttggtgctgggattctttttttttctggatgccagcttaaaaagcgggctccattatatttagtggatgccaggaataaactgttcacccagacacctacgatgttatatattctgtgtaacccgccccctattttgggcatgtacgggttacagcagaattaaaaggctaattttttgactaaataaagttaggaaaatcactactattaattatttacgtattctttgaaatggcagtattgataatgataaactcgaaatcactagtggatccgcccagcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacaaagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 98 - DNA, 8641 bp, Artificial Sequence
  plasmid pKR1256
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 99 - DNA, 8641 bp, Artificial Sequence
  plasmid pKR1277
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcttcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 100 - DNA, 8641 bp, Artificial Sequence
  plasmid pKR1278
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaacatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaacggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctcctcagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaagc

SEQ ID NO: 101 - DNA, 11647 bp, Artificial Sequence
  plasmid pKS392
  misc_feature (2349)..(2349): n is a, c, g, or t
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatggaggtgcgcagacgcaagattgacgttctcaaggcccagaagaatggttacgagtccggcccaccatctagacagtcctctcagccatcctctagagcctcctccagaacacgcaacaagcactcctcctccacactttccctttccggcctcaccatgaaggtgcagaagaagccagctggtccaccagccaactccaagaccccattcctccacatcaagccagtgcacacttgctgctccacctcaatgctctccagagactacgacggctccaacccatccttcaagggcttcaagaacatcggcatgatcatcctcatcgtgggcaatcttcgcctcgccttcgagaactacctcaagtacggcatctccaaccccttcttcgaccccaagatcacaccctccgagtggcagctttctggacttctcatcgttgtggcttacgctcacatcctcatggcttacgctatcgagtccgctgccaagctcctcttcctctcctccaagcaccactacatggccgttggtctcctccacaccatgaacaccctctcctccatttccctcctctcctacgtggtgtactactacctccccaatccagtggctggcactatcgttgagttcgtggccgtgatcctttctctcaagctcgcttcctacgcccttaccaactccgatctcagaaaggctgccattcacgcccagaagctcgacaagacacaggacgacaacgagaaggagtccacctcctcttcctcttcctctgacgacgccgagacacttgccgacatcgacgttatcccagcttactacgctcagcttccctacccacagaacgttaccctctccaacctcctctacttctggttcgctcccacccttgtgtaccagcccgtttacccaaagacagagagaatccgccccaagcatgtgatccgcaacctcttcgagcttgtgtctctctgcatgctcatccagttcctcatcttccagtacgcctaccccatcatgcagtcttgccttgccctcttcttccagccaaagctcgactacgccaacatttccgagcgcctcatgaagctcgcctctgtgtccatgatggtgtggctcatcggtttctacgccttcttccagaacggtctcaacctcatcgccgagctcacctgcttcggtaaccgcacattctaccagcagtggtggaactccagatctattggccagtactggacactctggaacaagcccgtgaaccagtacttccgccatcacgtttacgttcctcttctcgctaggggcatgtccagattcaacgcctctgttgtggtgttcttcttctccgctgtgattcacgagctccttgtgggcattcccacacacaacatcatcggcgctgccttcttcggaatgatgtcccaggtgccacttatcatggccaccgagaaccttcagcacatcaactcctcccttggcccattccttggtaactgcgctttctggttcaccttcttccttggtcagcctacctgcgcctttctctactaccttgcctacaactacaagcagaaccagtaggc

SEQ ID NO: 102 - DNA, 11611 bp, Artificial Sequence
  plasmid pKS393
  misc_feature (2349)..(2349): n is a, c, g, or t
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcatgaccatcgactcccagtactacaagtcccgcgacaagaacgacaccgctcccaagattgctggtatccgctacgctcctctgtctactccactcttgaaccgctgcgagactttctctttggtgtggcacatcttctccatccctaccttcctcaccatcttcatgctctgctgtgccattcccttgctctggcccttcgtgatcgcttacgttgtgtacgccgtgaaggatgactccccttccaacggcggtgttgtgaagcgctattcccctatctcccgcaacttcttcatctggaagctctttggccgctacttccccatcaccctccacaagaccgttgatttggagcccacccacacttactatcccttggacgtccaagagtaccacctgattgctgagcgctattggcctcagaacaagtacctgcgcgccatcattaccaccatcgagtacttcctgcccgctttcatgaagcgttccctctccatcaacgagcaggagcagcctgctgagagagaccctctgttgtctcccgtttccccctcttctcctggttctcagcccgacaagtggatcaaccatgattcccgctattccagaggtgagtcctctggctccaatggtcatgcttctggctctgaactgaatggcaatggcaacaacggcactaccaatcgccgccctctttcttctgcttccgctggctctactgcttctgactctaccttgctcaacggctctctcaactcctacgccaaccagatcattggcgagaacgaccctcagttgtctcccactaagctcaagcctactggcaggaagtacatcttcgggtaccatcctcacggtatcattgggatgggcgcctttggtggcattgctactgaaggtgctggctggtccaagctctttcctggtatccccgtttccctcatgaccctcaccaacaactttcgcgttcctctctatcgcgagtacctcatgtccctgggcgttgcttccgtttctaagaagtcctgtaaggccctcctcaagcgtaatcagtccatctgcatcgtggtgggtggtgcccaggaatccttgttggctaggcctggtgttatggatctcgtgttgctgaagcgcaagggttttgtgcgcttgggtatggaggtgggcaatgttgccctcgttccaatcatggctttcggcgagaacgatctctacgaccaggtgtccaacgacaagtcctccaagctgtaccgcttccagcagttcgtgaagaacttcctcggcttcaccctccctctcatgcatgccagaggtgtgttcaactacgatgttgggctcgttccctaccgccgccctgtgaacattgtggttggttctcctatcgacttgccttacctccctcatcccaccgatgaggaagtttccgagtaccacgaccgttacatcgctgagctccagcgcatctacaacgagcacaaggacgagtacttcatcgactggactgaggagggtaagggcgctcctgagtttcgtatgatcgagtaggc

SEQ ID NO: 103 - DNA, 11649 bp, Artificial Sequence
  plasmid pKS391
  misc_feature (2349)..(2349): n is a, c, g, or t
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggatcctcgaagagaagggttaataacacacttttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggcccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccgtcgacggcgcgccgctctagaactagtggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggcccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggcc

SEQ ID NO: 104 - DNA, 24 bp, Artificial Sequence
  primer MWG619
gcatatcaataagcggaggaaaag

SEQ ID NO: 105 - DNA, 19 bp, Artificial Sequence
  primer MWG620
ggtccgtgtttcaagacgg

SEQ ID NO: 106 - DNA, 560 bp, Artificial Sequence
  primer TD 26S
gcatccttgacgtaagtcgcagtcctcagtcccagctggcagtatttctacaggatataacacttaccgaggcaagctacattcctgcagatttatcctgccgccaaaactgatgctggcccagtgagctgcgagattcccccacccacaaggagcagagggcgcaaaacaccatgtctgatcaaatgcccttccctttcaacaatttcacgtactttttcactctcttttcaaagttcttttcatctttccatcactgtacttgttcgctatcggtctctcgccaatatttagctttagatggaatttaccacccacttagagctgcattcccaaacaactcgactcttcgaaagcactttacaaagaactgggatcctcgccacacgggattctcaccctctatgacgtcctgttccaaggaacatagacaaggaccagccccaaagttaccttctacaaattacaactcgggcaccgaaggtaccagatttcaaatttgagcttttgccgcttcactcgccgtactaaggcaatcccggttggtttcttttcctccg

SEQ ID NO: 107 - DNA, 29 bp, Artificial Sequence
  primer P7
  misc_feature (24)..(24): n is a, c, g, or t
aactacatcttcggctaycayccncaygg

SEQ ID NO: 108 - DNA, 29 bp, Artificial Sequence
  primer P8
  misc_feature (21)..(21): n is a, c, g, or t
  misc_feature (24)..(24): n is a, c, g, or t
agggactcggaggcgccgccncanacdat

SEQ ID NO: 109 - DNA, 29 bp, Artificial Sequence
  primer P7I
  misc_feature (24)..(24): n is inosine
aactacatcttcggctaycayccncaygg

SEQ ID NO: 110 - DNA, 29 bp, Artificial Sequence
  primer P8I
  misc_feature (21)..(21): n is inosine
  misc_feature (24)..(24): n is inosine
agggactcggaggcgccgccncanacdat

SEQ ID NO: 111 - DNA, 41 bp, Artificial Sequence
  primer BM DAT2 FWD
  misc_feature (3)..(3): n is inosine
  misc_feature (6)..(6): n is inosine
  misc_feature (12)..(12): n is inosine
  misc_feature (15)..(15): n is inosine
  misc_feature (21)..(21): n is inosine
  misc_feature (27)..(27): n is inosine
  misc_feature (36)..(36): n is inosine
ccnccnaaymgnccntayytnttyggntaycayccncaygg

SEQ ID NO: 112 - DNA, 40 bp, Artificial Sequence
  primer BM DAT2 REV
  misc_feature (8)..(8): n is inosine
  misc_feature (14)..(14): n is inosine
  misc_feature (20)..(20): n is inosine
  misc_feature (23)..(23): n is inosine
  misc_feature (26)..(26): n is inosine
  misc_feature (29)..(29): n is inosine
  misc_feature (35)..(35): n is inosine
  misc_feature (38)..(38): n is inosine
crttytcnccraanswraanacnggnacnarrtcngcncc

SEQ ID NO: 113 - DNA, 37 bp, Artificial Sequence
  primer DAT1 FWD
  misc_feature (8)..(8): n is inosine
  misc_feature (11)..(11): n is inosine
  misc_feature (14)..(14): n is inosine
  misc_feature (17)..(17): n is inosine
  misc_feature (20)..(20): n is inosine
  misc_feature (29)..(29): n is inosine
  misc_feature (32)..(32): n is inosine
ggtgggcnccnacnytngtntaycarccngtntaycc

SEQ ID NO: 114 - DNA, 41 bp, Artificial Sequence
  primer DAT1 REV
  misc_feature (15)..(15): n is inosine
  misc_feature (18)..(18): n is inosine
  misc_feature (21)..(21): n is inosine
  misc_feature (24)..(24): n is inosine
  misc_feature (27)..(27): n is inosine
  misc_feature (30)..(30): n is inosine
  misc_feature (33)..(33): n is inosine
ccdatdatrttrtgngtnggnacnccnacnarnarytcrtg

SEQ ID NO: 115 - protein, 10 aa, Artificial Sequence
  translation of primer site for P7 (SEQ ID NO:107)
NYIFGYHPHG

SEQ ID NO: 116 - protein, 10 aa, Artificial Sequence
  translation of primer site for P8 (SEQ ID NO:108)
IVVGGASESL

SEQ ID NO: 117 - protein, 13 aa, Artificial Sequence
  translation of primer site for BM DGAT2 FWD (SEQ ID NO:111)
  UNSURE (4)..(4): Xaa is any amino acid
  UNSURE (7)..(7): Xaa is any amino acid
PPNXPYXFGYHPH

SEQ ID NO: 118 - protein, 13 aa, Artificial Sequence
  translation of primer site for BM DGAT2 REV (SEQ ID NO:112)
  UNSURE (4)..(4): Xaa is any amino acid
  UNSURE (9)..(9): Xaa is any amino acid
GADXVPVFXFGEN

SEQ ID NO: 119 - protein, 13 aa, Artificial Sequence
  translation of primer site for DGAT1 FWD (SEQ ID NO:113)
WWAPTLVYQPVYP

SEQ ID NO: 120 - protein, 14 aa, Artificial Sequence
  translation of primer site for DGAT1 REV (SEQ ID NO:114)
HELLVGVPTHNIIG

SEQ ID NO: 121 - DNA, 263 bp, Torulaspora delbrueckii
aactacatcttcggctaccatcctcaaggtatcggggctctgggagctttcggtgccattggtactgaaggttgtggctggtccaagaagtttccaggtataaatgtctccttgatgacgttggttgcacagtttcatgtcccattgtacagggattacttattggcgttgggaattagtgcagtcacaaggaaaaactctttgaaagttctcgagaggaaccactccatttgtatcgttgtgggcggcgcctccgagtccct

SEQ ID NO: 122 - protein, 87 aa, Torulaspora delbrueckii
NYIFGYHPQGIGALGAFGAIGTEGCGWSKKFPGINVSLMTLVAQFHVPLYRDYLLALGISAVTRKNSLKVLERNHSICIVVGGASES

SEQ ID NO: 123 - DNA, 29 bp, Artificial Sequence
  sequencing primer for Torulaspora delbrueckii DGAT2
ccattggtactgaaggttgtggctggtcc

SEQ ID NO: 124 - DNA, 29 bp, Artificial Sequence
  sequencing primer for Torulaspora delbrueckii DGAT2
ggaccagccacaaccttcagtaccaatgg

SEQ ID NO: 125 - DNA, 30 bp, Artificial Sequence
  sequencing primer for Torulaspora delbrueckii DGAT2
gtcccattgtacagggattacttattggcg

SEQ ID NO: 126 - DNA, 30 bp, Artificial Sequence
  sequencing primer for Torulaspora delbrueckii DGAT2
cgccaataagtaatccctgtacaatgggac

SEQ ID NO: 127 - DNA, 26 bp, Artificial Sequence
  sequencing primer for Torulaspora delbrueckii DGAT2
ccctcattatgggcttcctaggttag

SEQ ID NO: 128 - DNA, 26 bp, Artificial Sequence
  sequencing primer for Torulaspora delbrueckii DGAT2
ctaacctaggaagcccataatgaggg

SEQ ID NO: 129 - DNA, 28 bp, Artificial Sequence
  sequencing primer for Torulaspora delbrueckii DGAT2
ccaaacccaacacaggaacaagtagatc

SEQ ID NO: 130 - DNA, 28 bp, Artificial Sequence
  sequencing primer for Torulaspora delbrueckii DGAT2
gatctacttgttcctgtgttgggtttgg

SEQ ID NO: 131 - DNA, 2567 bp, Torulaspora delbrueckii
  misc_feature (50)..(50): n is a, c, g, or t
caagagcacattccctttctttgctactcactcatatgaccaatagttgngagaaaaatcttgactcgaaccacatggctagcttggtcagctatcgcgtcttcgactagttaactaggcaaggtgagacatcctgcaaggactccaaggacttcaagaatgttacgtggcgcaccccactgctctcaacaccgtttcttgtccccccgtggatatcaaccgagcgcacgcccgaaactttgactatttgcaatccgagaaggaggtccagtagaccatttgttaacccagcgagatcaccaccgtgcattgggcattcctcgatcaattataaacatctatctggtcattggggtagcagtcgttttcccctttggtttattgatcttatcggtataggtcaacccgtgaaaattagcgacgcactagtcagttgaccgtccttgatccttgttggaaaagggttgacacatctgagcagttgttaagcaacttaatttggttttttccggcgaaatagatatatacttcctttgaaaggtttgtggtttgcccgagaggcagagagttcttaaaaggatttagtggcagtatgagagatacggagtttgagcagaaattacgtcaacgaactagggtcgatagaacggagcccacgaagcctgtcagtggtagtacaactcctgatacttctcttccagaggacgatgacaaggctaaggccaaagggggattctttaattctttgcgcgatgagatgtcctcatatcggtcggataggggaaggaaatccagtgatggacagttcggtgaggaaggtttggtccctcattatgggcttcctaggttagatgcttgttgttcaattcagactccaatgcgtagaagactgcagactgcgattgtggcatggcacatctcatcgtttgtgtttttagctgtactttcgatctatgcgttatcaaatccgatgctgtggtttgcgtctattccttatactatttattttatcttcgatagagcacctgggaatggtggtgtggttaagaggcgatcacattggtttaggtccttgcccatttggacttggtattgtgagtattttcctatcaacttagataagaccgtaccattaacaccaacttacacagagaagaagccatcaccgagtgaaaatactaagaaatcatcgatctttaacccaaagtcctggaaactcttcaggcgaagtgaaaagtatgaacggaccggcccgcgctacatctttggttaccatcctcatggtatcggggctctgggagcttttggtgccattggtactgaaggttgtggctggtccaagaagtttccaggtataaatgtctccttgatgacgttggtggcacagtttcatgttccattgtacagggattacttattagcgttgggaatcagcgcagtcacaaggaaaaactctttgaaagtactcgagcggaaccactccatttgtattgtcgtcggtggagctagagagtcactgatgagcagtattggttcagtggatttagtactgaaaagaaggaaggggtttattaggcttgctttagagagcggtaacgtatccttagtccctgtctttgggtttggtgaaactgattgttacaacatcgttcatacaagtgagaactcgttctctcataaagttcaactctggatgaaaaagaactacggttttaccatcccaatattttacgctcgtggactgttcaattacgacttcggtttccttccatttaggacccccatcacagtactgacaggcaatccgatctatgtggaaaagaaaataccaaacccaacacaggaacaagtagatcattaccacgatctgtacgttgaggaactaaagaagctctattacgataatagacataagtacggttacggtacagtagagatgcagattgccggttagaagataacagtatgtatttgataaaaaagttgtatagcctgaaatttaggtaaacagaaatcaatcagtatttttaccaaagtatcaagacttaaacttcaccactcacatatagaaaaaataagttatttatacctcgaatagctgttctttgactatcatataagatatacgatggctgtgggtttgaatttttatcgtgaggcggacttagttaaagaagctgtcataccagcccaagagggcacagttgtatcgtccggcgccaaggaagccactcttgatgcttctaaacaatctcctttgccacataaagctgtatcttttattggtaataatgaattgatcgatggtatatctgtgcggtccccagattacctttcaggcttcttccagaaattgagattacagttaacaggtactatcaatagactcactcgaaagctagatgaaaaatcatctgcttattataagcatgaacggaaattgacatcaacgatagcagatttgcattccgatcccagggaagaactgctgccagggtttgcatatatcgcagtggccgccatgtcgggttccgttctaacaaggaataagaacttcttgtttaggt

SEQ ID NO: 132 - DNA, 2700 bp, Torulaspora delbrueckii
  misc_feature (2580)..(2580): n is a, c, g, or t
  misc_feature (2640)..(2640): n is a, c, g, or t
  misc_feature (2642)..(2642): n is a, c, g, or t
aaaccttgactcgaaccacatggctagcttggtcagctatcgcgtctcgactagtcaactagacaatgtgggacatcctgcaaggacttcaagaatgttacgtggcgcaccccactgctctcaacaccgtttcttgccccccgtggataccagaccgagcgcacgcccgaaactttgactatttgcaatccgagaaggaggtcccagtggactatttgtgaacccagcgagatcaccaccgtctattgggcattcctcgatcaattatagacatctaactggccattggggtaccagtcgttttccccgttggtttattgatcttatcggtataggtcaacccgtgaaaattagcgacgcactggtcagttgaccgtctttgatccttgttggaaaagggttgacacatctgagcagttgttaagcaacttaatttggattgtttcggcgaaatagagatatatacttcctttgaagaggtttgtggtttgcccgagaggcagagagatcttaaagaaggatttagtggcagtatgagagatacggaatttgagcagaaattacgccagcgaactagggtcgatagaacggagcttacgaagcctgtcagtggtagtacgactcctgacacttctcttccggaggacgatgacaaggccaaagccaaaggggggttctttaattctttgcgcgatgagatgtcctcatatcggtcggataggagtaggaaatctagtggtggacagttcggtgaggaaggtttggtccctcattatgggcttcctaggttggatgcatgttgttcaattcagactccaatgcgtagaagattgcagactgcggttgtggcatggcacatctcatcgtttgtgtttttagctgtgctttcgatctatgcgttatcaaatccgatgctgtggtttgcgtctattccttatacgatttattttatcttcgatagagcacctgggaatggtggtgtggttaagaggggatcgcattggtttaggtccttgcccatttggacttggtattgtgagtattttcctatcaacttagataggaccacaccattaaaaccaacttacacagagaagaaaccatcaccgagtgaaaagactaaaaaatcatcgatttttaacccaaagtcctggaaactctttaggcgaactgaaaagtatgaactgaccggtccgcgctacatctttggttaccatcctcatggtatcggggctctgggagctttcggtgccattggtactgaaggttgtggctggtccaagaagtttccaggtataaatgtctccttgatgacgttggttgcacagtttcatgtcccattgtacagggattacttattagcgttgggaattagtgcagtcacaaggaaaaactctttgaaagttctcgagaggaaccactccatttgtattgtcgtcggtggagctagagagtcactgatgagcagtattggttcagtggatttattactgaaaagaaggaaggggtttattaggcttgctttagagagcggtaacgtatccttagttcctgtctttgggtttggtgaaactgattgttacaacatcgtacatacaagtgagaactctttctctcataaggtccaactctggatgaagaagaactacggttttaccatcccaatattctacgctcgtggactgttcaattacgacttcggtttccttccatttaggacgcccatcacagtactgacaggcaatccgatctatgtggaaaagaaaatatcaaacccaacaccggaacaagtagatcattaccacgatctgtacgttgaggaactaaagaagctctattacgataatagacacaagtacggttacggtacagtagagatgcaaattgccggttaaaatataacagtatgtatttgataaaaaagttgtatagcctgaaatttaggtaaacaggaatcaatcagtatttttaccaatgtataaacagctggttatttcataggattttttttttttagaaacttttagctcttaaatcaatcgcccttactaaataacctatgagtattaacattcaccactgggataagcaacgccatgaaattgcctgagaagagactattgactaaggatgatatgcaactatggcaaaattgccagacaaagagtgatcttctaaagttcttatgtgaactggcggatgccgtcaaaggtcttgagaactcgcagtacagtcaacccattggtggatccatacaatctgttgaggcactcatagaatgtgtcgatcagtgcattgagaatcatccggttgaatctactggcccatcaaggttcggcaaaggcgagtttcgtgacctttatgatgatatttcaggccgttctagcgtgctcatcaaggaaaagtttggttctctaacagatgagcaagttgctcagctctcggtctactttaacgaatcgtggggggataagagtagaattgattatggatcgggtcacgaattaaactttctatgtttcctttatgggctttaccgctgcggagtatttgacttggctaaggataatagaaatttgntgcttattgtattcatgaaataccttaaaactatgagagtaatagagactgtatactggntnagagccagcgggatctcatggtgtttgggggctcgatgattaccacttcttacctttt

SEQ ID NO: 133 - DNA, 1362 bp, Torulaspora delbrueckii
atgagagatacggagtttgagcagaaattacgtcaacgaactagggtcgatagaacggagcccacgaagcctgtcagtggtagtacaactcctgatacttctcttccagaggacgatgacaaggctaaggccaaagggggattctttaattctttgcgcgatgagatgtcctcatatcggtcggataggggaaggaaatccagtgatggacagttcggtgaggaaggtttggtccctcattatgggcttcctaggttagatgcttgttgttcaattcagactccaatgcgtagaagactgcagactgcgattgtggcatggcacatctcatcgtttgtgtttttagctgtactttcgatctatgcgttatcaaatccgatgctgtggtttgcgtctattccttatactatttattttatcttcgatagagcacctgggaatggtggtgtggttaagaggcgatcacattggtttaggtccttgcccatttggacttggtattgtgagtattttcctatcaacttagataagaccgtaccattaacaccaacttacacagagaagaagccatcaccgagtgaaaatactaagaaatcatcgatctttaacccaaagtcctggaaactcttcaggcgaagtgaaaagtatgaacggaccggcccgcgctacatctttggttaccatcctcatggtatcggggctctgggagcttttggtgccattggtactgaaggttgtggctggtccaagaagtttccaggtataaatgtctccttgatgacgttggtggcacagtttcatgttccattgtacagggattacttattagcgttgggaatcagcgcagtcacaaggaaaaactctttgaaagtactcgagcggaaccactccatttgtattgtcgtcggtggagctagagagtcactgatgagcagtattggttcagtggatttagtactgaaaagaaggaaggggtttattaggcttgctttagagagcggtaacgtatccttagtccctgtctttgggtttggtgaaactgattgttacaacatcgttcatacaagtgagaactcgttctctcataaagttcaactctggatgaaaaagaactacggttttaccatcccaatattttacgctcgtggactgttcaattacgacttcggtttccttccatttaggacccccatcacagtactgacaggcaatccgatctatgtggaaaagaaaataccaaacccaacacaggaacaagtagatcattaccacgatctgtacgttgaggaactaaagaagctctattacgataatagacataagtacggttacggtacagtagagatgcagattgccggttag

SEQ ID NO: 134 - DNA, 1362 bp, Torulaspora delbrueckii
atgagagatacggaatttgagcagaaattacgccagcgaactagggtcgatagaacggagcttacgaagcctgtcagtggtagtacgactcctgacacttctcttccggaggacgatgacaaggccaaagccaaaggggggttctttaattctttgcgcgatgagatgtcctcatatcggtcggataggagtaggaaatctagtggtggacagttcggtgaggaaggtttggtccctcattatgggcttcctaggttggatgcatgttgttcaattcagactccaatgcgtagaagattgcagactgcggttgtggcatggcacatctcatcgtttgtgtttttagctgtgctttcgatctatgcgttatcaaatccgatgctgtggtttgcgtctattccttatacgatttattttatcttcgatagagcacctgggaatggtggtgtggttaagaggggatcgcattggtttaggtccttgcccatttggacttggtattgtgagtattttcctatcaacttagataggaccacaccattaaaaccaacttacacagagaagaaaccatcaccgagtgaaaagactaaaaaatcatcgatttttaacccaaagtcctggaaactctttaggcgaactgaaaagtatgaactgaccggtccgcgctacatctttggttaccatcctcatggtatcggggctctgggagctttcggtgccattggtactgaaggttgtggctggtccaagaagtttccaggtataaatgtctccttgatgacgttggttgcacagtttcatgtcccattgtacagggattacttattagcgttgggaattagtgcagtcacaaggaaaaactctttgaaagttctcgagaggaaccactccatttgtattgtcgtcggtggagctagagagtcactgatgagcagtattggttcagtggatttattactgaaaagaaggaaggggtttattaggcttgctttagagagcggtaacgtatccttagttcctgtctttgggtttggtgaaactgattgttacaacatcgtacatacaagtgagaactctttctctcataaggtccaactctggatgaagaagaactacggttttaccatcccaatattctacgctcgtggactgttcaattacgacttcggtttccttccatttaggacgcccatcacagtactgacaggcaatccgatctatgtggaaaagaaaatatcaaacccaacaccggaacaagtagatcattaccacgatctgtacgttgaggaactaaagaagctctattacgataatagacacaagtacggttacggtacagtagagatgcaaattgccggttaa

SEQ ID NO: 135 - protein, 453 aa, Torulaspora delbrueckii
MRDTEFEQKLRQRTRVDRTEPTKPVSGSTTPDTSLPEDDDKAKAKGGFFNSLRDEMSSYRSDRGRKSSDGQFGEEGLVPHYGLPRLDACCSIQTPMRRRLQTAIVAWHISSFVFLAVLSIYALSNPMLWFASIPYTIYFIFDRAPGNGGVVKRRSHWFRSLPIWTWYCEYFPINLDKTVPLTPTYTEKKPSPSENTKKSSIFNPKSWKLFRRSEKYERTGPRYIFGYHPHGIGALGAFGAIGTEGCGWSKKFPGINVSLMTLVAQFHVPLYRDYLLALGISAVTRKNSLKVLERNHSICIVVGGARESLMSSIGSVDLVLKRRKGFIRLALESGNVSLVPVFGFGETDCYNIVHTSENSFSHKVQLWMKKNYGFTIPIFYARGLFNYDFGFLPFRTPITVLTGNPIYVEKKIPNPTQEQVDHYHDLYVEELKKLYYDNRHKYGYGTVEMQIAG

SEQ ID NO: 136 - protein, 453 aa, Torulaspora delbrueckii
MRDTEFEQKLRQRTRVDRTELTKPVSGSTTPDTSLPEDDDKAKAKGGFFNSLRDEMSSYRSDRSRKSSGGQFGEEGLVPHYGLPRLDACCSIQTPMRRRLQTAVVAWHISSFVFLAVLSIYALSNPMLWFASIPYTIYFIFDRAPGNGGVVKRGSHWFRSLPIWTWYCEYFPINLDRTTPLKPTYTEKKPSPSEKTKKSSIFNPKSWKLFRRTEKYELTGPRYIFGYHPHGIGALGAFGAIGTEGCGWSKKFPGINVSLMTLVAQFHVPLYRDYLLALGISAVTRKNSLKVLERNHSICIVVGGARESLMSSIGSVDLLLKRRKGFIRLALESGNVSLVPVFGFGETDCYNIVHTSENSFSHKVQLWMKKNYGFTIPIFYARGLFNYDFGFLPFRTPITVLTGNPIYVEKKISNPTPEQVDHYHDLYVEELKKLYYDNRHKYGYGTVEMQIAG

SEQ ID NO: 137 - DNA, 527 bp, Pichia anomala
tcctagtcaaagacgcagccctcgatccagacaggcaatatcagcagaagctataacactccaccgaagtgaagccacattcaactgccattatcttgccatccgaatcgatgctggcccagtgaaatacgagtgcacaactcaagaagagaagataatcgtaaaacaccaagtctgatctaatgcccttccctttcaacaatttcacgtactttttcactctcttttcaaagttcttttcatctttccatcactgtacttgttcgctatcggtctctcgccaatatttagctttagatggaatttaccacccacttagagctgcattcccaaacaactcgactcttcgatagcaccttacataggaatgggcatctcatcagacgggattctcaccctctatgacgtcctgttccaaggaacatagacaagagccaaacccaaggttaccatcttcaaattacaactcgaacaccgaaggtgctagatttcaaatttgagcttttgccgcttcactcgccgttact

SEQ ID NO: 138 - DNA, 263 bp, Pichia anomala
aactacatcttcggctatcatcctcaaggtgttgtttccttgagtggatttggtggtattggaactgacggagctaattggtctaagctgtttcctggaattccagtatgtttattgacacttttgaaccaattctatatcccactttatagagattaccttttggcccttggtataacttcagcaggtcgtaataatgccctcaaaatattgaagcaaggattctccttagcaatcgtcgtgggcggcgcctccgagtccct

SEQ ID NO: 139 - protein, 87 aa, Pichia anomala
NYIFGYHPQGVVSLSGFGGIGTDGANWSKLFPGIPVCLLTLLNQFYIPLYRDYLLALGITSAGRNNALKILKQGFSLAIVVGGASES

SEQ ID NO: 140 - DNA, 33 bp, Artificial Sequence
  sequencing primer for Pichia anomala DGAT2
ccttgagtggatttggtggtattggaactgacg

SEQ ID NO: 141 - DNA, 33 bp, Artificial Sequence
  sequencing primer for Pichia anomala DGAT2
cgtcagttccaataccaccaaatccactcaagg

SEQ ID NO: 142 - DNA, 30 bp, Artificial Sequence
  sequencing primer for Pichia anomala DGAT2
gccctcaaaatattgaagcaaggattctcc

SEQ ID NO: 143 - DNA, 30 bp, Artificial Sequence
  sequencing primer for Pichia anomala DGAT2
ggagaatccttgcttcaatattttgagggc

SEQ ID NO: 144 - DNA, 20 bp, Artificial Sequence
  sequencing primer for Pichia anomala DGAT2
ggtggtattggaactgacgg

SEQ ID NO: 145 - DNA, 2062 bp, Pichia anomala
aaaaaagacccgccaacaaatcatcaagtgtccaaaagaaacaggtccacctggacaaggaagtcaaatccgtttaaccaagatcagctataaattatccaagcatctttaagatataattgggtaaatcctttaatttgctgtttgtttgaagatttgtacaagtgcatgtgtcgaggcagtaaaagccattgtgtgatttttctttacaatcaattttttttgtttggcagttaaataatcctttgcttcaatttaccccataaaccattacaaacccaatcagcatccaaaaaccaattcatgatgcctgcaaaagacttgttagagagtaacgagctatcgcaaatttctgacgaggatgagttcccttcaaaaaatccagacaatgatgcttcaagtcttgaaaagaacatagttgtgccaaatgatggtcgagtgtttaagaaggcagatccaaaaagaacaaggggatcctctattggaaacgtcagagtcgctccattatctacacctctaccaagaagactacaaactgctgctgtcttgtggcataccatttcaattcctgttttcattactattttcttcatctcattagccattcccatcttttggttgattgcggttccgtatttattctacttattcacagatcgcacaccttcaaatggccaggtcaccaaaagatattcggagagattcagaaaattgagtgtttggaagtatttttgcaattattatccagtcaagctattcaagactcataatttagaaccaactttcacagaagtggaaattaaagatgattattacagattgccaccacctttgagttaccttttcaaaatcaataaaaaaccttacaagaagcttcaaaagactggtcctaaatatatatttggcctgcatccccatggtgttgtttccttgagtggatttggtggtattggaactgacggagctaattggtctaagctgtttcctggaattccagtatgtttattgacacttttgaaccaattctatatcccactttatagagattaccttttggcccttggtataacttcagcaggtcgtaataatgccctcaaaatattgaagcaaggattctccttagcaattgtcgttggtggcgcccaagaatctttattagcaagacctgaatctactgagattgtacttcaaaagagaaaaggattcatcaaattagctcttgaaacaggaaatgtatcacttgttccttgttattgttttggtgaaaatgaactatacaatatcttagaaccagatgaggactcctattggagaaagctgcaactctggttgaaaaaaagttttggatttacaatcccatttttccatgcaaggggtgtctttaattatgattttgggttattgcccttcagaaaagaagttacccttgttacagggaaaccaatacctgttccatttcttccaagtccaaaaaagactgaagttgattactaccatgagctttacgtgaacgagttgcaaagaattttcgatgaatacaagaccaaatttcaagaagatggccaaaacagtacgttaaaaatagtggagtaagatcagatcacataaacttcaattcaggaaaaaataaaaacacacataaacaaatttaaattaacgatttattggatactagtttgtaaaaaacttaaagctctaccttatttggacttataattttccattcaccatccactttgatgaacttgtgtttaaattcacctgctccagcagcttctttgggtattggagttggggtagattcttcaagtggtgcactcttgacttttggtgtagtaagctctgtatcatcaataggcactgcaacttcatcaggaaccattttctgagctggcagttttgaatgggatctagtcactcttgtacttcttggagtctctagaacttcaggggaagactttgtgcttgtagctggagggtgtataatagcttcaggtaacattgatcttcccaatttacaaacttgatttgcccactgtttaatgtcagtatttggagtttt

SEQ ID NO: 146 - DNA, 1290 bp, Pichia anomala
atgatgcctgcaaaagacttgttagagagtaacgagctatcgcaaatttctgacgaggatgagttcccttcaaaaaatccagacaatgatgcttcaagtcttgaaaagaacatagttgtgccaaatgatggtcgagtgtttaagaaggcagatccaaaaagaacaaggggatcctctattggaaacgtcagagtcgctccattatctacacctctaccaagaagactacaaactgctgctgtcttgtggcataccatttcaattcctgttttcattactattttcttcatctcattagccattcccatcttttggttgattgcggttccgtatttattctacttattcacagatcgcacaccttcaaatggccaggtcaccaaaagatattcggagagattcagaaaattgagtgtttggaagtatttttgcaattattatccagtcaagctattcaagactcataatttagaaccaactttcacagaagtggaaattaaagatgattattacagattgccaccacctttgagttaccttttcaaaatcaataaaaaaccttacaagaagcttcaaaagactggtcctaaatatatatttggcctgcatccccatggtgttgtttccttgagtggatttggtggtattggaactgacggagctaattggtctaagctgtttcctggaattccagtatgtttattgacacttttgaaccaattctatatcccactttatagagattaccttttggcccttggtataacttcagcaggtcgtaataatgccctcaaaatattgaagcaaggattctccttagcaattgtcgttggtggcgcccaagaatctttattagcaagacctgaatctactgagattgtacttcaaaagagaaaaggattcatcaaattagctcttgaaacaggaaatgtatcacttgttccttgttattgttttggtgaaaatgaactatacaatatcttagaaccagatgaggactcctattggagaaagctgcaactctggttgaaaaaaagttttggatttacaatcccatttttccatgcaaggggtgtctttaattatgattttgggttattgcccttcagaaaagaagttacccttgttacagggaaaccaatacctgttccatttcttccaagtccaaaaaagactgaagttgattactaccatgagctttacgtgaacgagttgcaaagaattttcgatgaatacaagaccaaatttcaagaagatggccaaaacagtacgttaaaaatagtggagtaa

SEQ ID NO: 147 - protein, 429 aa, Pichia anomala
MMPAKDLLESNELSQISDEDEFPSKNPDNDASSLEKNIVVPNDGRVFKKADPKRTRGSSIGNVRVAPLSTPLPRRLQTAAVLWHTISIPVFITIFFISLAIPIFWLIAVPYLFYLFTDRTPSNGQVTKRYSERFRKLSVWKYFCNYYPVKLFKTHNLEPTFTEVEIKDDYYRLPPPLSYLFKINKKPYKKLQKTGPKYIFGLHPHGVVSLSGFGGIGTDGANWSKLFPGIPVCLLTLLNQFYIPLYRDYLLALGITSAGRNNALKILKQGFSLAIVVGGAQESLLARPESTEIVLQKRKGFIKLALETGNVSLVPCYCFGENELYNILEPDEDSYWRKLQLWLKKSFGFTIPFFHARGVFNYDFGLLPFRKEVTLVTGKPIPVPFLPSPKKTEVDYYHELYVNELQRIFDEYKTKFQEDGQNSTLKIVE

SEQ ID NO: 148 - DNA, 328 bp, Debaryomyces hansenii
aactacatcttcggctakcayccgcacggtgtaatttctatgggagtcatgggagcttttgcaactaatgtaattcggaatgaaccatatcagcctccttttagtttcttaaagtcatttttccatgatccatctaagtacactagattattaccgggtattggcaatatctttcctttgactttaactactcaatttaccttacccttttaccgcgactatttaatgagcttgggattgacaagtgcatcttacaaaaacattaaaagtattattaataatggagataattctgtttgtcttgtcgttggcggcgcctccgagtccc

SEQ ID NO: 149 - protein, 109 aa, Debaryomyces hansenii
  UNSURE (6)..(6): Xaa is any amino acid
NYIFGXHPHGVISMGVMGAFATNVIRNEPYQPPFSFLKSFFHDPSKYTRLLPGIGNIFPLTLTTQFTLPFYRDYLMSLGLTSASYKNIKSIINNGDNSVCLVVGGASES

SEQ ID NO: 150 - DNA, 23 bp, Artificial Sequence
  sequencing primer for Debaryomyces hansenii DGAT2
cggaatgaaccatatcagcctcc

SEQ ID NO: 151 - DNA, 23 bp, Artificial Sequence
  sequencing primer for Debaryomyces hansenii DGAT2
ggaggctgatatggttcattccg

SEQ ID NO: 152 - DNA, 28 bp, Artificial Sequence
  sequencing primer for Debaryomyces hansenii DGAT2
gagcttgggattgacaagtgcatcttac

SEQ ID NO: 153 - DNA, 28 bp, Artificial Sequence
  sequencing primer for Debaryomyces hansenii DGAT2
gtaagatgcacttgtcaatcccaagctc

SEQ ID NO: 154 - DNA, 28 bp, Artificial Sequence
  sequencing primer for Debaryomyces hansenii DGAT2
ggctggatcatctggatatttgtgatcc

SEQ ID NO: 155 - DNA, 28 bp, Artificial Sequence
  sequencing primer for Debaryomyces hansenii DGAT2
ggatcacaaatatccagatgatccagcc

SEQ ID NO: 156 - DNA, 28 bp, Artificial Sequence
  sequencing primer for Debaryomyces hansenii DGAT2
gccaggatgatgactcctcaagtccaag

SEQ ID NO: 157 - DNA, 28 bp, Artificial Sequence
  sequencing primer for Debaryomyces hansenii DGAT2
cttggacttgaggagtcatcatcctggc

SEQ ID NO: 158 - DNA, 26 bp, Artificial Sequence
  sequencing primer for Debaryomyces hansenii DGAT2
gctaacccaaaaccgggatctcttgg

SEQ ID NO: 159 - DNA, 27 bp, Artificial Sequence
  sequencing primer for Debaryomyces hansenii DGAT2
cagtgccatttttcagtgccagaggtg

SEQ ID NO: 160 - DNA, 2800 bp, Debaryomyces hansenii
tccgttttttcctagggttaatccaataatgggttttctgattatcggcatctagtaaattagccttctccttattccttttactcatgatttggccatatatttatcttttgcattcttctgtgaaaaatttcccatatgggtttcctgtctcctttcgcggtctccatataaaaatatcctgaaagttgctgtattaggataactatctattagactattaattaggttaattcccgtctacgtccatattattcgtaatattgtttgctgttatacttaagagttattgctcacgataaccatgtcacagaactcattggatgaaaaaaataccacatctgacgataagaaacaacagttacggaggagacatggttcacacgatacaccatcagaaaatggcttgagaactccttctcggtctagcaccaaatccaattccaagccaaagtcacataggaagaagtcacttgtcaattttgcaccgttgaatactccgttacataataggttagaaactatgggggtaatctggcattgtctttccattccttttttcgtgagtctattcttattggcaatttcattaggctggatcatctggatatttgtgatccttccttactttatttggtggtatttctttgatttacatacacctacaaatggtaaaactgtctaccgggttaaagattggatgcagaatatcatagtctgggaatggtttgtgaactattttcctattagtatccataaggcatgcgatctcgaaccaacttttacgcaaatgcttgttgatgataatgaaggaaatgacgacgaagaagacctaatttcagaggattcaagaacaattattgataaattgttcaaaacattgggattgagaaaacgtttgaatgattcagattcgcataatgttctgaatacaccatcaagtgataaaaaatttgataaagctttgaaatataaaaaagaaagtactgggcctaggtatattttcggctaccacccgcacggtgtaatttctatgggagtcatgggagcttttgcaactaatgtaattcggaatgaaccatatcagcctccttttagtttcttaaagtcatttttccatgatccatctaagtacactagattattaccgggtattggcaatatctttcctttgactttaactactcaatttaccttacccttttaccgcgactatttaatgagcttgggattgacaagtgcatcttacaaaaacattaaaagtattattaataatggagataattctgtttgtcttgtcgttggtggtgcccaggaatcattgcttaataccatggtttcaccaaggcttagaatcggcaatggatataagaatgatgaaactgatgaaagtggagatgaatcagaacctatggtaaaggagtataatccgaaggaagtagaacattatagcattaaagaacaaatggatgaaaatttagatgagaacaaacatgaatccagcgaaagtgacagcaatctggacaccgaaaaaggccaagaaaaactcgatagcgaaaagcttattaaaactgagactgacaacgctgatcaacccggagaaaataaagataaaaacctcaatgatcataatgaaacagaaactgaaaaaccgggacaaagcgaagaaaaagaaagccaggatgatgactcctcaagtccaaggcaaattcagttggtattgaataagcggaaaggttttgttaaattagctattgaattaggcaatgtttgtttggtgccaacatttggatttggtgaggcagatatttatagaatagctaacccaaaaccgggatctcttggatcaagatttcaagaatggatgaaatctacatttcagtttacagtgccatttttcagtgccagaggtgtttttatatatgattttgggtttttaccatttagaaatcccattgatatatgcatgggtgagccaatttatgtcccgagtggactaattgcggactacaaattaaaacaccctggctttgattctgatgaagaagtagaacaaaacaacaagcaaaaaaaggaagatgaaaaaggagatgaaaccgattctaaaaagaaggacaagaaggattttaaaaagaaaggcaaaaaggattttaaaactgaaaaaaaagaggattctaaatcgaaagacaaaaagagagaaaaaaaaataaagattccttccgaaatactcaaccattaccataagttatacgtggatgggttgaagaaagtctatgaagaaaacaagtgtaagtttggttatgaagatgttgaattaattattattgaatagccttgataacgtagttattaaaaatgtaccgtattgactattatttaaactataaacatgtagagacctcgccgaggaggattataaatcattatcatcattaaacttgattaagttgaaatccttaggaattttaccttgttgctttaactgcttgtatctcttcaataattttctgtccaactttctacgaccagaagaattcactttgaaaaacgtcttggagttatgcaacaactgtttaaaatcttcaaattccttattgttgatttcctcttccttgatttctgtcttgtgtttttgtaattgcactttttcccattttttaaacccatccttagctatcgactgctcaaaaggaggactaccgaaaggtcttgtccttaggtattaaattccataaatactcgtcgtcaatatcgtttaacgacggattcaaattaatcatccccgataatgactttttca

SEQ ID NO: 161 - DNA, 2028 bp, Debaryomyces hansenii
atgtcacagaactcattggatgaaaaaaataccacatctgacgataagaaacaacagttacggaggagacatggttcacacgatacaccatcagaaaatggcttgagaactccttctcggtctagcaccaaatccaattccaagccaaagtcacataggaagaagtcacttgtcaattttgcaccgttgaatactccgttacataataggttagaaactatgggggtaatctggcattgtctttccattccttttttcgtgagtctattcttattggcaatttcattaggctggatcatctggatatttgtgatccttccttactttatttggtggtatttctttgatttacatacacctacaaatggtaaaactgtctaccgggttaaagattggatgcagaatatcatagtctgggaatggtttgtgaactattttcctattagtatccataaggcatgcgatctcgaaccaacttttacgcaaatgcttgttgatgataatgaaggaaatgacgacgaagaagacctaatttcagaggattcaagaacaattattgataaattgttcaaaacattgggattgagaaaacgtttgaatgattcagattcgcataatgttctgaatacaccatcaagtgataaaaaatttgataaagctttgaaatataaaaaagaaagtactgggcctaggtatattttcggctaccacccgcacggtgtaatttctatgggagtcatgggagcttttgcaactaatgtaattcggaatgaaccatatcagcctccttttagtttcttaaagtcatttttccatgatccatctaagtacactagattattaccgggtattggcaatatctttcctttgactttaactactcaatttaccttacccttttaccgcgactatttaatgagcttgggattgacaagtgcatcttacaaaaacattaaaagtattattaataatggagataattctgtttgtcttgtcgttggtggtgcccaggaatcattgcttaataccatggtttcaccaaggcttagaatcggcaatggatataagaatgatgaaactgatgaaagtggagatgaatcagaacctatggtaaaggagtataatccgaaggaagtagaacattatagcattaaagaacaaatggatgaaaatttagatgagaacaaacatgaatccagcgaaagtgacagcaatctggacaccgaaaaaggccaagaaaaactcgatagcgaaaagcttattaaaactgagactgacaacgctgatcaacccggagaaaataaagataaaaacctcaatgatcataatgaaacagaaactgaaaaaccgggacaaagcgaagaaaaagaaagccaggatgatgactcctcaagtccaaggcaaattcagttggtattgaataagcggaaaggttttgttaaattagctattgaattaggcaatgtttgtttggtgccaacatttggatttggtgaggcagatatttatagaatagctaacccaaaaccgggatctcttggatcaagatttcaagaatggatgaaatctacatttcagtttacagtgccatttttcagtgccagaggtgtttttatatatgattttgggtttttaccatttagaaatcccattgatatatgcatgggtgagccaatttatgtcccgagtggactaattgcggactacaaattaaaacaccctggctttgattctgatgaagaagtagaacaaaacaacaagcaaaaaaaggaagatgaaaaaggagatgaaaccgattctaaaaagaaggacaagaaggattttaaaaagaaaggcaaaaaggattttaaaactgaaaaaaaagaggattctaaatcgaaagacaaaaagagagaaaaaaaaataaagattccttccgaaatactcaaccattaccataagttatacgtggatgggttgaagaaagtctatgaagaaaacaagtgtaagtttggttatgaagatgttgaattaattattattgaatag

SEQ ID NO: 162 - protein, 675 aa, Debaryomyces hansenii
MSQNSLDEKNTTSDDKKQQLRRRHGSHDTPSENGLRTPSRSSTKSNSKPKSHRKKSLVNFAPLNTPLHNRLETMGVIWHCLSIPFFVSLFLLAISLGWIIWIFVILPYFIWWYFFDLHTPTNGKTVYRVKDWMQNIIVWEWFVNYFPISIHKACDLEPTFTQMLVDDNEGNDDEEDLISEDSRTIIDKLFKTLGLRKRLNDSDSHNVLNTPSSDKKFDKALKYKKESTGPRYIFGYHPHGVISMGVMGAFATNVIRNEPYQPPFSFLKSFFHDPSKYTRLLPGIGNIFPLTLTTQFTLPFYRDYLMSLGLTSASYKNIKSIINNGDNSVCLVVGGAQESLLNTMVSPRLRIGNGYKNDETDESGDESEPMVKEYNPKEVEHYSIKEQMDENLDENKHESSESDSNLDTEKGQEKLDSEKLIKTETDNADQPGENKDKNLNDHNETETEKPGQSEEKESQDDDSSSPRQIQLVLNKRKGFVKLAIELGNVCLVPTFGFGEADIYRIANPKPGSLGSRFQEWMKSTFQFTVPFFSARGVFIYDFGFLPFRNPIDICMGEPIYVPSGLIADYKLKHPGFDSDEEVEQNNKQKKEDEKGDETDSKKKDKKDFKKKGKKDFKTEKKEDSKSKDKKREKKIKIPSEILNHYHKLYVDGLKKVYEENKCKFGYEDVELIIIE

SEQ ID NO: 163 - DNA, 550 bp, Candida zeylanoides
aaagaaaccaacagggattgcctcagtaacggcgagtgaagcggcaaaagctcaaatttgaaatctagcaccttcagtgttcgagttgtaatttgaagaaggtaactttggttttggctcttgtctatgttccttggaacaggacgtcacagagggtgagaatcccgtgcgatgagatgcccaattccatgtaaagtgctttcgaagagtcgagttgtttgggaatgcagctctaagtgggtggtaaattccatctaaagctaaatattggcgagagaccgatagcgaacaagtacagtgatggaaagatgaaaagaactttgaaaagagagtgaaaaagtacgtgaaattgttgaaagggaagggcttgagatcagacttggtattttgcgttcccttcctttttggttgggttcctcgcagtttactgggccagcatcggtttggatggtaggataatgacattggaatgtagctttacttcggtgaagtgttatagactttgttgatactgcctatctagaccgaggactgcgtcttgactaggatg

SEQ ID NO: 164 - DNA, 325 bp, Candida zeylanoides
aactacatcttcggctaccatccccacggcgtcatttcgatgggggtgatgggcacctttggcaccaacgccatccgcaacgagccctttgagccgccgctcaagtttttgaagccgttgttccacgacccctcgggcaaagagcgtcttttgcccgacattgagaagatcttcccctcgacgttgagcacgcagttcacgctcccgttctaccgcgactacctcctcagcctcggcttgacgagcgccgcggcaaagaacatcaagagcttgattcagaacggcgacaactccatagtttggggcggcgcctccgagtccctaa

SEQ ID NO: 165 - protein, 108 aa, Candida zeylanoides
NYIFGYHPHGVISMGVMGTFGTNAIRNEPFEPPLKFLKPLFHDPSGKERLLPDIEKIFPSTLSTQFTLPFYRDYLLSLGLTSAAAKNIKSLIQNGDNSIVWGGASESL

SEQ ID NO: 166 - DNA, 26 bp, Artificial Sequence
  sequencing primer for Candida zeylanoides DGAT2
gtcatttcgatgggggtgatgggcac

SEQ ID NO: 167 - DNA, 26 bp, Artificial Sequence
  sequencing primer for Candida zeylanoides DGAT2
gtgcccatcacccccatcgaaatgac

SEQ ID NO: 168 - DNA, 26 bp, Artificial Sequence
  sequencing primer for Candida zeylanoides DGAT2
gcgccgcggcaaagaacatcaagagc

SEQ ID NO: 169 - DNA, 26 bp, Artificial Sequence
  sequencing primer for Candida zeylanoides DGAT2
gctcttgatgttctttgccgcggcgc

SEQ ID NO: 170 - DNA, 26 bp, Artificial Sequence
  sequencing primer for Candida zeylanoides DGAT2
cccactggcgggcgccgacagcacgc

SEQ ID NO: 171 - DNA, 26 bp, Artificial Sequence
  sequencing primer for Candida zeylanoides DGAT2
gcgtgctgtcggcgcccgccagtggg

SEQ ID NO: 172 - DNA, 28 bp, Artificial Sequence
  sequencing primer for Candida zeylanoides DGAT2
gcgcgtctacgaggataacaaggacaag

SEQ ID NO: 173 - DNA, 28 bp, Artificial Sequence
  sequencing primer for Candida zeylanoides DGAT2
cttgtccttgttatcctcgtagacgcgc

SEQ ID NO: 174 - DNA, 3021 bp, Candida zeylanoides
agtcgccactcaaaccgccacactcgcccattcagcgcccccacggactgcggcttggctctaccctaatagagtaatgaaattgcgagctgcgtgtattcctgcgcgtcatgcaccgtgggctaaccaccgcgagtggcgctgatatgttctcgggggcgccacctggcggcgtgcgggcagcactggcccgccagcaccggcgccgctggctaacaccggcgaggggcattagccttttgcgattggcgccacgatccttcccctcatcgtgcccacctgcattgttgcacattatcgctcggcgcggtcccaaacaagaagacaaaacaagcaacccgcagcaacgctcaagacccgcacgccgccgcgttttgctgaagcacccagcgcagcggcgccgggcctaccccacctcgtcaaggcaggggcaccgccagaggtcggtgcggggccttcgctggcgccaaatcttaaatgctgcaaaccttcatgaaaaaaaaatcattaaaaaatatgccttttgcggccctacagttgctccacgcctgcaaatgggaaactccctgttttggcagatcgatgtagattggcggtggcgccccgcattctctgactagggacttctttcttctctgcctcccgatggaaaacgacgcggcccacctcaccagaaggaagcccaaacacccactggcgggcgccgacagcacgcaccgcgacgccgatcggcggcccaccaccccaaccagatcgccgccgctggcgcggctcaagctccacatcgcgccgatcaacacccccatgaagcaccagttgcaaacgttggggttgatctggcacaccatcctgattcccttcttcatgtttgtgtttctcttcaccctctacttggggtgggtggcgtggttgatgatgatcttgccctacttcatctggtggtacggcttcgacttgcacacgcccgccaacggcaagacgcagtaccgctacaaggactgggtgcgcaacctcattgtgtgggagtggtttgtggactacttcccgatcagggtgcacaaggcgtgcgagttggaacccaccttcctgcacgtgctcgttgaggagacgctggcgcagcccgacgacgaagaggacctagtgctggagaactcgcgcaccttgctcgataccgtgttcaagcggttggggttgcagaagcgcatcaacgtcattgacgggtacctgccgccggcctccggcggccgcaaaaagcacaaaaaggtgctgacgggcccgcgctacatctttggctaccacccgcacggcgtcatttcgatgggggtgatgggcacctttggcaccaacgccatccgcaacgagccctttgagccgccgctcaagtttttgaagccgttgttccacgacccctcgggcaaagagcgtcttttgcccgacattgagaagatcttcccctcgacgttgagcacgcagttcacgctcccgttctaccgcgactacctcctcagcctcggcttgacgagcgccgcggcaaagaacatcaagagcttgattcagaacggcgacaactccatcgtgttggtggtgggtggggcacaggagtctcttttgaacgacgtggtggcgtcgcacgcgcacgtgggcaacggttacacggggccacgtcaaaaggaggatccacagcagcatcagcagcagcagctgctgctgctgctgctgccgctgctggacacctcgggccctccgcaatccagagaaatccgtctcgtgttgaacaaacgcaagggcttcgtcaaaattgccatcgagctcggcaacatcagcttggtgccgatctttgcgtttggagaggccgacatctacaacgtcaacatccccgacaagggcacgtggggcgagcaatttcagctatggatgaaaaaggtgttcagcttcacgctcccctttttcagtgctcgcggcgtgttcatctacgactttggctttttgccctaccgccacccgatcaacttgtgcatggggcgacccattcacatccctgcaggtacgttgcaggagtacaagttgaagcacccggactgggacgagtccggcgacaagcctgcggcaacgcacctcgacgcggtcaagcacacctcgagcagaagcaactcgttctctaacttgttcaagttgaatcaaaagagcgccgcccccaagcccacgccgtccaaaacgattgtgccccccaaattgctagaccactaccaccggctttacatggatgagttaaagcgcgtctacgaggataacaaggacaagtttggctacagcgatgtcaagttgaacattgtcgagtgatctcaataaatccgtgtatgctatttgtcgtcatcctttttccctagtttcccctccgtttgtaactttctgaaggttttgaccaacttgcggttcaactttttgcggccgccggggaccgggcccaagaaggaattcgtcttgctaaactccttgatggcctggtcggcctcctgctgctctttcaagctgcgttgcaacttgagctgtgcctgctgcttcattttggcctcccaccgacgaaacccgtcgagagtggcggtgtatccgtcaaagggtggcgagttaaagaattttccctgcggcaccaactgccacaagtattcgttcgcgatctgatgcaaccgcgggttcaagggcacgagcttcagccacgaccgcttgagtggatgctcaacgtggggcggctgatgtaaatcggaaaactcggccggtaggagcgacagaaagtcgttgagctcgttcaagaggcgatcagcttcgttgttgggctgagccccgtgcaagtagcggctcgggatgccgaaatcgtggtacgattgagcggtcggtagttgcagtggcggtgaaggggcagcggcgtgccgcgggacaccaatctcgtcggcgttggcggggtaaaacgcgcggttgagccgcacctggttcaacatgctctcggaagcgttgcggatcgccttc

SEQ ID NO: 175 - DNA, 1695 bp, Candida zeylanoides
atggaaaacgacgcggcccacctcaccagaaggaagcccaaacacccactggcgggcgccgacagcacgcaccgcgacgccgatcggcggcccaccaccccaaccagatcgccgccgctggcgcggctcaagctccacatcgcgccgatcaacacccccatgaagcaccagttgcaaacgttggggttgatctggcacaccatcctgattcccttcttcatgtttgtgtttctcttcaccctctacttggggtgggtggcgtggttgatgatgatcttgccctacttcatctggtggtacggcttcgacttgcacacgcccgccaacggcaagacgcagtaccgctacaaggactgggtgcgcaacctcattgtgtgggagtggtttgtggactacttcccgatcagggtgcacaaggcgtgcgagttggaacccaccttcctgcacgtgctcgttgaggagacgctggcgcagcccgacgacgaagaggacctagtgctggagaactcgcgcaccttgctcgataccgtgttcaagcggttggggttgcagaagcgcatcaacgtcattgacgggtacctgccgccggcctccggcggccgcaaaaagcacaaaaaggtgctgacgggcccgcgctacatctttggctaccacccgcacggcgtcatttcgatgggggtgatgggcacctttggcaccaacgccatccgcaacgagccctttgagccgccgctcaagtttttgaagccgttgttccacgacccctcgggcaaagagcgtcttttgcccgacattgagaagatcttcccctcgacgttgagcacgcagttcacgctcccgttctaccgcgactacctcctcagcctcggcttgacgagcgccgcggcaaagaacatcaagagcttgattcagaacggcgacaactccatcgtgttggtggtgggtggggcacaggagtctcttttgaacgacgtggtggcgtcgcacgcgcacgtgggcaacggttacacggggccacgtcaaaaggaggatccacagcagcatcagcagcagcagctgctgctgctgctgctgccgctgctggacacctcgggccctccgcaatccagagaaatccgtctcgtgttgaacaaacgcaagggcttcgtcaaaattgccatcgagctcggcaacatcagcttggtgccgatctttgcgtttggagaggccgacatctacaacgtcaacatccccgacaagggcacgtggggcgagcaatttcagctatggatgaaaaaggtgttcagcttcacgctcccctttttcagtgctcgcggcgtgttcatctacgactttggctttttgccctaccgccacccgatcaacttgtgcatggggcgacccattcacatccctgcaggtacgttgcaggagtacaagttgaagcacccggactgggacgagtccggcgacaagcctgcggcaacgcacctcgacgcggtcaagcacacctcgagcagaagcaactcgttctctaacttgttcaagttgaatcaaaagagcgccgcccccaagcccacgccgtccaaaacgattgtgccccccaaattgctagaccactaccaccggctttacatggatgagttaaagcgcgtctacgaggataacaaggacaagtttggctacagcgatgtcaagttgaacattgtcgagtga

SEQ ID NO: 176 - protein, 564 aa, Candida zeylanoides
MENDAAHLTRRKPKHPLAGADSTHRDADRRPTTPTRSPPLARLKLHIAPINTPMKHQLQTLGLIWHTILIPFFMFVFLFTLYLGWVAWLMMILPYFIWWYGFDLHTPANGKTQYRYKDWVRNLIVWEWFVDYFPIRVHKACELEPTFLHVLVEETLAQPDDEEDLVLENSRTLLDTVFKRLGLQKRINVIDGYLPPASGGRKKHKKVLTGPRYIFGYHPHGVISMGVMGTFGTNAIRNEPFEPPLKFLKPLFHDPSGKERLLPDIEKIFPSTLSTQFTLPFYRDYLLSLGLTSAAAKNIKSLIQNGDNSIVLVVGGAQESLLNDVVASHAHVGNGYTGPRQKEDPQQHQQQQLLLLLLPLLDTSGPPQSREIRLVLNKRKGFVKIAIELGNISLVPIFAFGEADIYNVNIPDKGTWGEQFQLWMKKVFSFTLPFFSARGVFIYDFGFLPYRHPINLCMGRPIHIPAGTLQEYKLKHPDWDESGDKPAATHLDAVKHTSSRSNSFSNLFKLNQKSAAPKPTPSKTIVPPKLLDHYHRLYMDELKRVYEDNKDKFGYSDVKLNIVE

SEQ ID NO: 177 - DNA, 517 bp, Lipomyces starkeyi
ggtgggsgccgacgttggtgtatcaaccggtgtacccgcgatcgccttcattccggcctttgttttttgtcaagcggattctggagatggtgggcctatcatttttaatatggttcttgtcagctcaatatgctgtgccgacgctagaaaatagtttggtgcattttcacagtttgcaattcatgggaattatggagcgactcatgaagcttgctagcattagcatggctatttggcttgctggttttttctgcatttttcagtctggactcaatgcgcttgcggaggtaatgcggtttggtgacagagccttttacgacgactggtggaacagcaaatctgtgggagagtattggcgtctgtggaataagccggttacgaattacttccggcgtcatatttacgtaccgcttgtgcgccgcgggtggaattctgcgacagccagtgtcatggtatttttcgtcagcgcggtgttgcacgaactcctcgtcggcgtccccacccacaacatyattgr

SEQ ID NO: 178 - protein, 171 aa, Lipomyces starkeyi
  UNSURE (2)..(2): Xaa is any amino acid
WXPTLVYQPVYPRSPSFRPLFFVKRILEMVGLSFLIWFLSAQYAVPTLENSLVHFHSLQFMGIMERLMKLASISMAIWLAGFFCIFQSGLNALAEVMRFGDRAFYDDWWNSKSVGEYWRLWNKPVTNYFRRHIYVPLVRRGWNSATASVMVFFVSAVLHELLVGVPTHNII

SEQ ID NO: 179 - DNA, 263 bp, Lipomyces starkeyi
aactacatcttcggctatcacccgcayggaattgttagcttgggtgcgtttggtgctattggtacggaaggcgctggrtgggagaagctctttcctgggatcccggtgtcactgctgactctcgaaacaaatttcagccttccattttacagagagtatttgctgtcacttgggattgcttcagtatctcgacggtcttgtaccaatctcctcaaacacgaccaatccatctgcatagtytgmggcggcgcctccgagtccct

SEQ ID NO: 180 - protein, 87 aa, Lipomyces starkeyi
  UNSURE (81)..(81): Xaa is any amino acid
NYIFGYHPHGIVSLGAFGAIGTEGAGWEKLFPGIPVSLLTLETNFSLPFYREYLLSLGIASVSRRSCTNLLKHDQSICIVXGGASES

SEQ ID NO: 181 - DNA, 28 bp, Artificial Sequence
  sequencing primer for Lipomyces starkeyii DGAT1
gtcaagcggattctggagatggtgggcc

SEQ ID NO: 182 - DNA, 28 bp, Artificial Sequence
  sequencing primer for Lipomyces starkeyii DGAT1
ggcccaccatctccagaatccgcttgac

SEQ ID NO: 183 - DNA, 30 bp, Artificial Sequence
  sequencing primer for Lipomyces starkeyii DGAT1
ccgcttgtgcgccgcgggtggaattctgcg

SEQ ID NO: 184 - DNA, 30 bp, Artificial Sequence
  sequencing primer for Lipomyces starkeyii DGAT1
cgcagaattccacccgcggcgcacaagcgg

SEQ ID NO: 185 - DNA, 20 bp, Artificial Sequence
  sequencing primer for Lipomyces starkeyii DGAT1
cgctgagcgaagcgacgtag

SEQ ID NO: 186 - DNA, 20 bp, Artificial Sequence
  sequencing primer for Lipomyces starkeyii DGAT1
cccattttggggttggagcg

SEQ ID NO: 187 - DNA, 20 bp, Artificial Sequence
  sequencing primer for Lipomyces starkeyii DGAT1
ttgatttgcttctggtcccg

SEQ ID NO: 188 - DNA, 20 bp, Artificial Sequence
  sequencing primer for Lipomyces starkeyii DGAT1
cgtgcccattgcatggattc

SEQ ID NO: 189 - DNA, 3343 bp, Lipomyces starkeyi
  misc_feature (5)..(5): n is a, c, g, or t
  misc_feature (11)..(11): n is a, c, g, or t
  misc_feature (23)..(23): n is a, c, g, or t
  misc_feature (45)..(45): n is a, c, g, or t
  misc_feature (47)..(47): n is a, c, g, or t
  misc_feature (61)..(61): n is a, c, g, or t
aatgncgtcgntgctgacttctnattatgcgagacggaagatcgncncgctgcataatcgntacggctcttggttgacgcggcttacctccggtcgatctcccaacgctttgctttgcacaactagttcgctttatcgtcgcctataatttatacccggaaacttgaagattggataagttcagtctcatactatttcctgagcataatactaggaatgctagatcacatcagctcgggaacagcaactgcctcaacaacgacagtcatgtcgaccgctgcacaatctgatacagacaacgaggatatatcgactgtcgatttggttgactctcgtgcagatactcacacatcttcaaatgttatgttgcaacagcaaaaatcgcgtcggagactaatcgggaaagacgccgagccaagaacacagcatccgtctggaggcaaatcggagaaggaggagttgacgaagccggatgactcaaagggacccataaaattaagtcacatatacccgatacatgccgttagccgaggcagtattctgtcacgagagtcgacaactcctacaccgagttttgttgggtttcgaaacttagccatgatagtgctagggaagttacagtattcattattcttttggtgcgatcgggctaacattccgacagccgtcagcaatcttcgattggtgattgaaaattactcaaaggtatgcctgctcgacagaaataattgtggctgtatgacgagctgactttgaacagtacggcgttctgatccgattcgcccgactcggtatttcacaaaaggacattctgtattgcatattcttgaccgctaccatcccgctgcacctatttattgctattgtcattgaaagactagttgcgattccgacggtaaactacgtcgctcgctcagcgagagcgaggataaaaaacgctccaaccccaaaatgggacggaaggggggcagtatatcgattttgcgtcctaagccaaaatatatgtggcgcctgatcgtcctattgcattcaataaacgcaatggcttgcttgtgggttacgactgttgttgtttacaattctatttatcatccccttattgggacagcttgtgaatttcatgcaggtgagctatactctaatttgtggtacgcattgtaccgctaacaagttgacagtgattgtgtgtcttaaggtcgcatcgtttgcgcttaccaatcgcgatcttcgggagtcgatgctgaactctcaacctgtgccagccatatacaacttggccccttatccaaaaaacttaaccctcaagaacttgtcatacttttggtgggcgccgactcttgtttatcaacctgtctatccgcgatcgccttcattccggcctttgttttttgtcaagcggattctggagatggtgggcctatcatttttaatatggttcttgtcagctcaatatgctgtgccgacgctagaaaatagtttggtgcattttcacagtttgcaattcatgggaattatggagcgactcatgaagcttgctagcattagcatggctatttggcttgctgggtatgttcggatagcaactttggtctcgtgatgataaactaatttcgttagttttttctgcatttttcagtctggactcaatgcgcttgcggaggtaatgcggtttggtgacagagccttttacgacgactggtggaacagcaaatctgtgggagagtattggcgtctgtggaataagccggttacgaattacttccggcgtcatatttacgtaccgcttgtgcgccgcgggtggaattctgcgacagccagtgtcatggtatttttcgtcagcgcggtgttgcatgagctagttgttggagttccgacgcataacgtaattgggtacgattgcctttatatagtatgaaaattgctgttaactgagttaataacagagttgcattctcgtcgatgattctacaaatcccactcatacaagtaaccgcgcctctggagaagatgcatggacctacatctggaataatagggaactgtatcttttggtttagcttcttcatcggtcagcctctgggcgtgctactttactattttgcgtggaacgttagtatgagcaaagtaaagatggtcgagagctagaatattcggtactaccgatgcttccatttttgatttatttaatgagggaatgtcttcgataagtgagcagcccagggaaatgaggctttagtaaacctctttcttttgtaccttaccacgatatttctatttggatccctttccgccttgcaatctcctaatttcgaatgcattctccgatttgattattcacacagtttctttacttttctcttccttcacatttcaatttcgtgcccattgcatggattctacaccgtctaatcttttcgttaccttgtttctttgatttgcttctggtcccgttttgctgttatgcttgatattatataagcatggagtttgtggcatcgtcgagcatgcattacttagagtttttggttacgatggtcaaacgggatgatgattttgttatattggttatgaataaagtggaactatttagccagtcttactcctcacaatttgcagtaatttcatacttcaagtgaaacaatatataatatgctgcatgataaaacttttatttgagattttgcctcattaattctttccattcataaatggcgaaaaaatatgcgtaatacaaaatatacatacacctaatacaagtagctcatcaaccgaccgcgaaaactgctccatacctataaatatgtataatctctataccatgctgtatattattacattgaacatataccaacgaatctctaaccatgaaaaagagaatgaaacacctcaccgttagaatacagcaaaaactccaagcccccaaaccacattatgacgagaaaaactaaacaaatatcatgcaatggaagaattcgtctccccgacagaagacttggtgattataatgtgcacattaaaaacaagaaattaacccctccttcctgtcccgaattcagtgacagcagacaaatcaaaccatacgacccgaacaagctgagaatatgcagatagtgaatttatgactctaatactgactttctaaaactcccctccccccaaagatgatcatagtaagtaattactcggcatcaacggtgacagattccgtctcggcaacatcgtcgattgcagcagcctcccgaacaattcgtctgttctcgtagtatatgacgcaaagagccaagatacccgcaataatagcagcaggagggtgataataaacgcatttctgtagcaatcacgt

SEQ ID NO: 190 - DNA, 30 bp, Artificial Sequence
  sequencing primer for Lipomyces starkeyii DGAT2
gggtgcgtttggtgctattggtacggaagg

SEQ ID NO: 191 - DNA, 30 bp, Artificial Sequence
  sequencing primer for Lipomyces starkeyii DGAT2
ccttccgtaccaatagcaccaaacgcaccc

SEQ ID NO: 192 - DNA, 29 bp, Artificial Sequence
  sequencing primer for Lipomyces starkeyii DGAT2
gggattgcttcagtatctcgacggtcttg

SEQ ID NO: 193 - DNA, 29 bp, Artificial Sequence
  sequencing primer for Lipomyces starkeyii DGAT2
caagaccgtcgagatactgaagcaatccc

SEQ ID NO: 194 - DNA, 2090 bp, Lipomyces starkeyi
ttagtcagaaaggttarcattagttaactagtgataaattcgactgcggggtagacgcagtatgmcaagcggatagcgccctaaacgtaacagatgcgaccgcagaggcctttaactcayttcgcttagccttcatgtcgacgatttaagaccatgcatggcgtcgcagtgccccaccttcctccccctctcgctcccgatttccgcttcgtccggctgcccgtcgactgcctcttcgctgtgctggcctttacatatttagaacaaacggatcatcggacaagcggcattttctgtatcattttagcaatgagtgagaaggcagagatcgaggttccgccgcaaaaatcgtgagtacgtcggatgcttgcttaggacagatgctgattgctatttaggacattccctcgcagtgtgcacttcgctccacttcatattccactggagagacgcctacagactttggcagtcttattgtaagtctcgtctaccttacggtgacatggagtcgctaatgatatgagggtagccacactgtcgcgctaccatactgcatcggtctgttctttctcatgctcgcgttccctcctttttggccattattggtaatgtatgtcatatacgcatacgggttcgaccactcgagctcgaacggagagatctcccgccggcgatcgccgctgtttcgaagactcccgttgttcaggctgtattgtgattacttccccatccacattcaccgggaggttccgctcgagccgacgtttcctggtcgccttcgcgaaccgagtggccttgtcgagcggtggattgcgaagatgttcggcgtgcaggacgctgttgtcgagggaaatgaatctgacgttaaggccacggccaacggcaatgggacgacgaaagaaatcggaccgacgtatgttttcggctatcatccgcatggaattgttagcttgggtgcgtttggtgctattggtacggaaggcgctggatgggagaagctctttcctgggatcccggtgtcactgctgactctcgaaacaaatttcagccttccagtaggttgatgtttgggtttgtctgccatgggatagtactaataacagattagttttacagagagtatttgctgtcacttgggattgcttcagtatctcgacggtcttgtaccaatctcctcaaacacgaccaatccatctgcatcgttatcggcggcgcccaagagtcgctcttagcggaaccaggcactctagatctgatcctcgttaaacgtcgcggttttgtcaaacttgcaatgtcaacggcgcgggtatctgaccaaccgatttgtcttgttccgatcctcagtttcggcgagaacgacgtgtacgaccaagtccgcggggaccgatcgtcgaagttgtataagatccagacttttatcaagaaagcggccgggtttacgctaccattgatgtatgcgcgcggtatatttaattacgactttgggctgatgccgtaccgcaggcaaatgacgctcgtggtcggcaagccgattgcagtgccgtacgtggcccagcctacggaggctgaaatcgaagtgtatcacaagcagtacatggatgaattgaggaggttatgggacacgtataaggacgactattttgtagaccacaagggcaagggggtcaagaattccgagatgcgttttgtggagtaaaacgaaaatattttggcacgcggcgtattggagttttgcatctttgacaatcgttctgcacatttcaccactctgggacggaatcttgtttgccaagaatatctgccttcagaaatgacagcggccgtatcgccgtttctgtcaattgtgctgcgaattaagaatcaaccacgcttttcaaatttctcacctgtatttgcatgatttacatgctagatatttgtcttcatagcaggcagtcacctccggttataatgcaggacgggcgaattgtcgtctttgtcttcttgcggtcgcatgcgacmaaatcaaagaattgaatatttttaaagtctatttattatcttcctccagtactaratattcgaccactcggtcgtcgatggccagtctg

SEQ ID NO: 195 - DNA, 474 bp, Rhodotorula glutinis
ccgccgaacggccgtatttgttcgggtatcacccgcacggcgtcatcggcatgggcgccatcgccaactttggcaccgacgcgactgggttctcgcgcctgttcccgggcatcacgccgcacctcctcacgctcgcgagcaacttcaagctgcccgtgtaccgcgagctcctcctcggcctcggcatctcgtccgtctcgatgaagagctgccagaacatcctgcggcaaggtgcgccctccctccctctctctccccgttcccaccgctcgcccgagccccgactgaccctctctcgaccttcccccccaggtcccggctcttccatcacgatcgtcgtcggcggcgcagctgagagcctgagcgcgcaccccggaacggccgacctgacgctcaagcggcgcaagggcttcatcaagctcgcgatccgcaccggcgccgacctcgtccccgtcttcaccttcggcgagaacg

SEQ ID NO: 196 - protein, 157 aa, Rhodotorula glutinis
AERPYLFGYHPHGVIGMGAIANFGTDATGFSRLFPGITPHLLTLASNFKLPVYRELLLGLGISSVSMKSCQNILRQGAPSLPLSPRSHRSPEPRLTLSRPSPPGPGSSITIVVGGAAESLSAHPGTADLTLKRRKGFIKLAIRTGADLVPVFTFGEN

SEQ ID NO: 197 - DNA, 20 bp, Artificial Sequence
  sequencing primer for Rhodotorula glutinis DGAT2
gcttgatgaagcccttgcgc

SEQ ID NO: 198 - DNA, 20 bp, Artificial Sequence
  sequencing primer for Rhodotorula glutinis DGAT2
gcgcaagggcttcatcaagc

SEQ ID NO: 199 - DNA, 20 bp, Artificial Sequence
  sequencing primer for Rhodotorula glutinis DGAT2
gccaaagttggcgatggcgc

SEQ ID NO: 200 - DNA, 20 bp, Artificial Sequence
  sequencing primer for Rhodotorula glutinis DGAT2
gcgccatcgccaactttggc

SEQ ID NO: 201 - DNA, 20 bp, Artificial Sequence
  sequencing primer for Rhodotorula glutinis DGAT2
gtgtgcggcctgaaaccggg

SEQ ID NO: 202 - DNA, 20 bp, Artificial Sequence
  sequencing primer for Rhodotorula glutinis DGAT2
gcagtgggtgcatgggtcag

SEQ ID NO: 203 - DNA, 20 bp, Artificial Sequence
  sequencing primer for Rhodotorula glutinis DGAT2
gaaggcgacgatgccgtggc

SEQ ID NO: 204 - DNA, 2944 bp, Rhodotorula glutinis
cgtccaacgagagctcgaggtcgaagtagctcgtcgcgcctcgagccactcgtgcgcgaacgggagaggggccatgttcactgcatgcctgaagcgcggtacgaagagtggggcacagaagagaaaaggcgctcgaggcggggcgcaggtacaacggcggacgaggcaggtaggtacttttcgacgacgagcgtcgtcacgcgatgatggtgagctccttggtgcggctcttggcgtacacctccttgtagtcctcccagatcctgcgggcgaggagggcgaggcgtcagcgacgaggttcgtgcgacgagggagcgggagaggggggaactcgaggacggacctcttgagctcggcgatgtagcgctcctgcacctcctcgaggtcggcagtcgaagggtggtccttctgcttgaccttgatcgggcgaccgactacgagagaaaaaagtagggcacgagagtgagctcgcgacgacgaggaggctcgaccgcacgccgctgcagagggagaggacgcaccgaccgagacaatcgggtgtcgatacggcatcaggcccatgttgtctgcgggtgagggacaaggagagggtcagtgcgacggtcaagagctggactcgacgaggagggggagggggagggacgcacagttgaacaagccgcggccgaagaagatggctgcgcgcacgccgacgtcagtgctgctctgtgggtggtggacggggagggagagacgaggacgcacgcagagtgaagccaaagacggcctggaaccgcttttggagcttgtacaggcgcgtccctcgctcgttcgacaactggttgaagatctgcgcgcgcagcaacgaggtcaggacgcgctcgaggcggcaagagcgggagagagaccgaggacgcacgtcgttctcgccaaaggaaaagacgggcacgagcgaggcgccggtgcggatcgcgagcttgatgaagcccttgcgccgcttgagcgtcaggtcggccgttccggggtgcgcgctcaggctctcagctgcgccgccgacgacgatcgtgatggaagagccgggacctgggggggaaggtcgagagagggtcagtcggggctcgggcgagcggtgggaacggggagagagagggagggagggcgcaccttgccgcaggatgttctggcagctcttcatcgagacggacgagatgccgaggccgaggaggagctcgcggtacacgggcagcttgaagttgctcgcgagcgtgaggaggtgcggcgtgatgcccgggaacaggcgcgagaacccagtcgcgtcggtgccaaagttggcgatggcgcccatgccgatgacgccgtgagggtggtacccaaagacgtagcgctggtcgggcgggaggtcggcgctctgcgggacgagggagaggtcagctggtgctctttggggggcgtcggcgggaggctcgaggtcggcgccgtgcggctcgacgcgaggcatttagcgtaccttgatgaggctgcggcgcgcgcagagagagaagtaagcttgggcgagcgtgcgcagggcagaaggcgaggaagagggggagctgggcgcacctgaccgggtagtagccggcgaaccactcccagacgcgcgacttgcgcagccacgcttgcggtctcccgccgcgcattggcgcctggtcgatgaggaacacccaggtgaggtacccgatgacgagcggccagagaggagggaatgagctgcgagggcccgagagagtcagctttccgtggctcctgggcagagccggaccatgaagagagagcctcggcgcaccagaggatgcagaagatgccgagcgagatggggagcgcggtcgtccagagaaacaccgagaaggtctgaaggcgacgatgccgtggcacgacaaagggcacgaacctgcacggggcgcagtgggtgcatgggtcagctctgtacggtgtgcgccggtcctgcgtgccgtgtgcggcctgaaaccgggacctcggggacgaggtgggggaagggcgaggaggacgaggagagagagggcgcacttgatcttggagtgctccgactggtcgtattcgacctcttcttgtgcgcccatcgtgcgtgtcgggcagcctggccccaggcgcgaggatggcggaggagagggagcaaggtcgcgacgtcgccgagcgggagtgcgtctctctcgccgcagctcccgccgccctcggctgcggattgctttgcagctgctcgagtctcacgcaagcctggagccggccctgtccaaggctcgccccgagcgagaggcagctgtcgtgctcgaaacgcggggagcgcgtgccagcgttctcctgcttgcctcgagctcctcacgctgttcagagcgtagtacgagtgccgcagtagccagcgcttgcgaaagagcgcggcgagaaagccgatgcggccggtgtctcagccggaattctcatcagctcctcgtcgactcctccgcttgtccgtccgcttccgctctaccatcacgctttatcgcagagctgcgactgccagccgtccccgccacttctacccgccacttttatggcgtcggcacgcgcgccagagctcctgttcccgtcggccgtgagctcgttgaaggaggaccggagcgagatccggctgcagctcagggacacgtgcgtcccgctccctcctcccacaatgccacccaaagccgactcttgccctcccgcagcttcaatcgcctgcactcgatcgcgcacgacgccgagttcatccacgaggaggtcgcgcaggcgttccccgacttccctgttgtcggtgcgtccctctctctgggtccatctcgtgacagcattgacgatggcaaccacagcgaaccagcgagccggcgcgtggtacgtcaagccgtccgacgagaaagcgcacgcctacttcaagtgcgccctcgctctccctcac

SEQ ID NO: 205 - DNA, 397 bp, Phaffia rhodozyma
ccgccgaaccggccgtatttgtttgggtatcatccgcacggtgtcatcgggatgggagctttcgccaactttgctacagaaggcactaacttctcaaagatatttcctggaattgaaccccaccttttaacactcgctcctaattttaagataccactgtatcgggacttgcttcttcttctaggaatgtgctctgtttcaaaaagatcatgttcttccatccttcgtaaagggccccctggtacagccatcgtaatcgttgttggaggtgctactgagtcgcttcgggcccacccgggaacagccgacttgacactcaagagtagaatgggtttcatcaaaattgccataaatgagggcgccgacctcgtccccgtcttcacctttggcgagaatg

SEQ ID NO: 206 - protein, 132 aa, Phaffia rhodozyma
PPNRPYLFGYHPHGVIGMGAFANFATEGTNFSKIFPGIEPHLLTLAPNFKIPLYRDLLLLLGMCSVSKRSCSSILRKGPPGTAIVIVVGGATESLRAHPGTADLTLKSRMGFIKIAINEGADLVPVFTFGEN

SEQ ID NO: 207 - DNA, 32 bp, Artificial Sequence
  sequencing primer for Phaffia rhodozyma DGAT2
gtcatcgggatgggagctttcgccaactttgc

SEQ ID NO: 208 - DNA, 32 bp, Artificial Sequence
  sequencing primer for Phaffia rhodozyma DGAT2
gcaaagttggcgaaagctcccatcccgatgac

SEQ ID NO: 209 - DNA, 30 bp, Artificial Sequence
  sequencing primer for Phaffia rhodozyma DGAT2
cccgggaacagccgacttgacactcaagag

SEQ ID NO: 210 - DNA, 30 bp, Artificial Sequence
  sequencing primer for Phaffia rhodozyma DGAT2
ctcttgagtgtcaagtcggctgttcccggg

SEQ ID NO: 211 - DNA, 34 bp, Artificial Sequence
  RACE primer for Phaffia rhodozyma DGAT2
ggccacgcgtcgactagtactttttttttttttt

SEQ ID NO: 212 - DNA, 20 bp, Artificial Sequence
  RACE primer for Phaffia rhodozyma DGAT2
ggccacgcgtcgactagtac

SEQ ID NO: 213 - DNA, 36 bp, Artificial Sequence
  RACE primer for Phaffia rhodozyma DGAT2
  misc_feature (24)..(25): n is inosine
  misc_feature (29)..(30): n is inosine
  misc_feature (34)..(35): n is inosine
ggccacgcgtcgactagtacgggnngggnngggnng

SEQ ID NO: 214 - DNA, 1218 bp, Phaffia rhodozyma
atggatccacagacagatccttcatctccgacccagtcgcctgtacttccaaaggaaggactcagtcttcgtccgacaaggtcaaaatcatccctggttgagttcggatcgtcatccatcagtggactcagggacaatatctcgacagggatcaacacactctccactggtctcaagacccaagttgagaagagacggaaagatctcccaaaaggaattgaaataaagtttgcgcccctcaaagtcccaagaaaccgccgtttacaaacaggcgccgtggctctctggtcaacccttcttccgatatgcacttctatctttctctggatgtgctctatcccgagactgtggcctctcttgattccttatcttatctgggtgttctacatcgaccgcgcgcccgtactcggcggcagacccaaacgatggctcagaaggatgggcatctggaaacactttgccaattattatcctgtctctctagtacaagaggcttccctgcctttagacaggaagtacatctttggatatcacccgcacggtgtcatcgggatgggagctttcgccaactttgctacagaaggcactaacttctcaaagatatttcctggaattgaaccccaccttttaacactcgctcctaattttaagataccactgtatcgggacttgcttcttcttctaggaatgtgctctgtttcaaaaagatcatgttcttccatccttcgtaaagggccccctggtacagccatcgtaatcgttgttggaggtgctactgagtcgcttcgggcccacccgggaacagccgacttgacactcaagagtagaatgggtttcatcaaaattgccataaatgagggcgttgacttggtaccggtgttttcgtttggcgaaaacgatatctatgatcagctagcgaatgagagagggacacagatctacaaactacagaaaagattccaaagcatctttgggtttactttgcccttgttccacggaagagggttattcaattattcggttggtctgatgccatataggcaacccattgtttctgtagccggaaggccgatccgagttgtccagtgtaacaacccgacatcggagcagttgcaggagacacaaggacggtacatcgaggagcttttacggatctgggatacatataaggacgtgtatgctaggaacagaacaaaagagttgacgcttgtggactga

SEQ ID NO: 215 - protein, 405 aa, Phaffia rhodozyma
MDPQTDPSSPTQSPVLPKEGLSLRPTRSKSSLVEFGSSSISGLRDNISTGINTLSTGLKTQVEKRRKDLPKGIEIKFAPLKVPRNRRLQTGAVALWSTLLPICTSIFLWMCSIPRLWPLLIPYLIWVFYIDRAPVLGGRPKRWLRRMGIWKHFANYYPVSLVQEASLPLDRKYIFGYHPHGVIGMGAFANFATEGTNFSKIFPGIEPHLLTLAPNFKIPLYRDLLLLLGMCSVSKRSCSSILRKGPPGTAIVIVVGGATESLRAHPGTADLTLKSRMGFIKIAINEGVDLVPVFSFGENDIYDQLANERGTQIYKLQKRFQSIFGFTLPLFHGRGLFNYSVGLMPYRQPIVSVAGRPIRVVQCNNPTSEQLQETQGRYIEELLRIWDTYKDVYARNRTKELTLVD

SEQ ID NO: 216 - DNA, 269 bp, Cryptococcus curvatus
aactacatcttcggctatcatccgcaygggattataggcatgggagctgtcgcggcctttgcgtccgaggcgacagggttctccgactacttccccggaatcaggccgcacctcctcaccctagacacaaacttcaacatccccttctaccgcgagatactcatgtggctgggcatctgctcggtctccaaggcgtcgtgcaggaacatcctggccaagggtccgggctatgccatcaccatagtctgcggcggcgcctccgagtccct

SEQ ID NO: 217 - protein, 89 aa, Cryptococcus curvatus
NYIFGYHPHGIIGMGAVAAFASEATGFSDYFPGIRPHLLTLDTNFNIPFYREILMWLGICSVSKASCRNILAKGPGYAITIVCGGASES

SEQ ID NO: 218 - DNA, 35 bp, Artificial Sequence
  sequencing primer for Cryptococcus curvatus DGAT2
ggcatgggagctgtcgcggcctttgcgtccgaggc

SEQ ID NO: 219 - DNA, 35 bp, Artificial Sequence
  sequencing primer for Cryptococcus curvatus DGAT2
gcctcggacgcaaaggccgcgacagctcccatgcc

SEQ ID NO: 220 - DNA, 31 bp, Artificial Sequence
  sequencing primer for Cryptococcus curvatus DGAT2
cctggccaagggtccgggctatgccatcacc

SEQ ID NO: 221 - DNA, 31 bp, Artificial Sequence
  sequencing primer for Cryptococcus curvatus DGAT2
ggtgatggcatagcccggacccttggccagg

SEQ ID NO: 222 - DNA, 30 bp, Artificial Sequence
  sequencing primer for Cryptococcus curvatus DGAT2
gcggcgtgcggttgtggtcgtacccggccc

SEQ ID NO: 223 - DNA, 29 bp, Artificial Sequence
  sequencing primer for Cryptococcus curvatus DGAT2
cccagatcatgtacgggatgagcactggc

SEQ ID NO: 224 - DNA, 27 bp, Artificial Sequence
  sequencing primer for Cryptococcus curvatus DGAT2
ccttccgccaccccatcgtcactgtcg

SEQ ID NO: 225 - DNA, 29 bp, Artificial Sequence
  sequencing primer for Cryptococcus curvatus DGAT2
cgctcttccacgggcgcgggctcttcaac

SEQ ID NO: 226 - DNA, 2816 bp, Cryptococcus curvatus
agaacggcgcccgactaccccgtctcctcgcattcactctcacgctcaactagcgcctccacttcaggcggtcactctccgcaatcactctgtcagagatacaccacgtccacagaaacaccacctcactccttatctgcatctgtacactcgttcgctcccccccctaccacactcccctttcagccatgatggcagaggtcctatcggtatccgcgtcggcgtcgcccagctccagcatctccagcacgacctcaaccgaacccaccaccgacattggcgagggcagtctggggctgtcacctggcccagcgggcctccgcctacggttcccacgcaacggtgggagcctaacccaccattcctcagactacggcaaggacctgtcaccggccccgtcgctgctcaccctgcactcggcgcccgactccccagacgccaactctccagcctcggagcggagcgacctctactctgactatgacctgcccgatcccgacacggggcctgccgtgcccgtcgcccgtaggaaaaggagtgccagcgatgggccgactcccgggtcgctcatgcttacggcgctggacgagaagccggtgaagaccaagagcaagatacagcggttgaagagcaagagcccgttgctggagagtctcaagctcccgccgctcagcgagatcagcattccccgaccagaacagatcaagtgagtagcttctatcgtgtagcgcgataagcactgctatcgcctcgccttgctcgctgtagcttgacgctggccgacgcagcgctcatcgctccctcgttacccacgtgcaggctgactccagattcgcacctttgcatatccctcctcaccgccgactgcagaccgcagcagtcgcgacatgggcactgctcatgcccctttgtttcattgcattcctctttgcattgtaagtgctatcgggctcgggccgggtacgaccacaaccgcacgccgcccctcgcgtcatcgctgacctcagatcattcccccgcctatggccagtgctcatcccgtacatgatctggggggtcttcttcgaccaagcgcccgagcacggagggcgtcccaagaagtgggcgcgtcggttcttcatgtggaagtactatgcgcgtgagtactagctacggggttgaagtagggcgcatggctgatgggcagaatattatccatgcaggtgagttgtgccacgctggcggagtgcgcgatatcggcgtgtcggtgtccgctcggcccggagtaggtgaacgtttactgacgcggtgtcctgcagcatcgtaaaggtgagcgacccagggccatagtgcggcaactaacggcaggaagccgatctcccagccagcaacaaatacgtcttcggctaccacccacatgggattataggcatgtgcgtcgatgagcagggacatcccgctgacttgcaggggagctgtcgcggcctttgcgtccgaggcgacagggttctccgactacttccccggaatcaggccgcacctcctcaccctaggtgagtaccgcgatgcggggcaggtgggcccccgagcaacaacgccattgccgccgctactcaccgcactcccttgcccatgctgaccgcagacacaaacttcaacatccccttctaccgcgagatactcatgtggctgggcatctgctcggtctccaaggcgtcgtgcaggaacatcctggccaagggtccgggctatgccatcaccattgtcgtgggcggcgcggccgagtccctcgcagcccacccgggcacgcaggatctcacgctgaagaagcgctttggctttgtaaaggtcgcaatcagggagggcgcacagcttgtgcccgtgttttcctttggcgagaatgacgtgagtcgcccgggatacctgcgctgaccccagatttacgaccagctgtgcgtccgcaactcgcgtgcttatccccgctaaccccagtgcaaacgagaagggctcaacagtgtacaagctgcagaagacgttccaaaagatcttcgggttcaccctcccgctcttccacgggcgcgggctcttcaactacaactacgggctcatggtgggtaatcaaactgagggcagaactaaccccagcccttccgccaccccatcgtcactgtcggtgcgcatttgaatacgccgtagtgctgtgctgaccccagtcggccgccccgtcacggtgaagcagaacctcaacccccaggacgaggaggtgcaagaagtgcaccgccgctacatcgaggagctggtgcgcgtctgggacaagtacaaggatatatatgccaagaacaggtcgcgggagctcagcattgtcgagtaggtcggttttgttttgtgttttgtcgtggatagattgcatatgcagtgtatggagtattgtacggcggagggagttggtggtggctagtggttgacggctgtactgagccagtgtacagacacccaccacgaatctcagtttgcgcttctcctccttcagcgagggactgcagagactgcaggcaagtgaacagcatgctcaagtggacggcagaggctcccattgagtgaggatctgatcctccccaacggcttttaagtggaaaaccgcatgatatcttcaaggcgccgtagcacaacaactaccacactaagaagtgcgtgtccttcgggattcaatttcgatcacgagtttcgacccgtggtcgcggcgtttttgctatctttttgcgcgaatgagcgcacccgaatgaaatgtgctcttcacgatcttggactgctctccgttatctaggatgttgtgagtg

SEQ ID NO: 227 - DNA, 394 bp, Mucor circinelloides
ccgccgaataggccgtatctgttcgggtaccacccgcatggcatcatcagtatcagcagttttgctagttttgctacggaagcaacagggttctctcaactgtttcctggtatcattccctctctattgaccttgacaaccaactttaaatttcccatctatcgcgatatcattcttgccttgggtattgcttctgtttcgcgtcattcctgtgaaaagattctatcatctggtcctggtcgttcgattgtgattgtcattggaggtgcatctgaatccctgaatgctcgtccaggcatcgcagatctcgtactgaaaaagagattaggtttcatccgaatcgcgattcgtcatggcgccgatctcgtccccgtctttaccttcggcgaaaaaa

SEQ ID NO: 228 - protein, 131 aa, Mucor circinelloides
PPNRPYLFGYHPHGIISISSFASFATEATGFSQLFPGIIPSLLTLTTNFKFPIYRDIILALGIASVSRHSCEKILSSGPGRSIVIVIGGASESLNARPGIADLVLKKRLGFIRIAIRHGADLVPVFTFGEK

SEQ ID NO: 229 - DNA, 28 bp, Artificial Sequence
  sequencing primer for Mucor circinelloides DGAT2
gcagttttgctagttttgctacggaagc

SEQ ID NO: 230 - DNA, 28 bp, Artificial Sequence
  sequencing primer for Mucor circinelloides DGAT2
gcttccgtagcaaaactagcaaaactgc

SEQ ID NO: 231 - DNA, 32 bp, Artificial Sequence
  sequencing primer for Mucor circinelloides DGAT2
gagattaggtttcatccgaatcgcgattcgtc

SEQ ID NO: 232 - DNA, 32 bp, Artificial Sequence
  sequencing primer for Mucor circinelloides DGAT2
gacgaatcgcgattcggatgaaacctaatctc

SEQ ID NO: 233 - DNA, 1110 bp, Mucor circinelloides
atgaaagaacctgtcagcaaggaaaacacagatacaaaatcggacagaaagattgctttgccagacatcaagaaagtatcacaagtcattcccaatgtgcccgaggtacaatgggcgcctttgacaggtattccgtttgaaagaaggatccagatggccgtcgtcttgatgtggatctttcttttgggcaactgcctaaccctcttttgctgctccctgtttcttccattcctgtggcctttgcacattgcttacatcatctacctttatcgcgatcagtcggcagagaatggcggtcgtcgttcagattggttccgtcgcttgcctatctggaattattatgctggttattttcctgccaaattggtcaaggagcaagatcttgatcccaaaaagaattacgtctttgggtcgcatccacacggcatcatcagtatcagcagttttgctagttttgctacggaagcaacagggttctctcaactgtttcctggtatcattccctctctattgaccttgacaaccaactttaaattccccatctatcgcgatatcattcttgccttgggtattgcttctgtttcgcgtcattcctgtgaaaagattctatcatctggtcctggtcgttcgattgtgattgtcattggaggtgcatctgaatccctgaatgctcgtccaggcatcgcagatctcgtactgaaaaagagattaggtttcatccgaatcgcgattcgtcatggagccgatctagtgcccgtcttttcatttggtgaaaacgaattgtatgaacaagtcgataattcgacaggtagttggctttggaaggcgcaaaaaaagatgcaacaggcacttggattcactatgcccttgtttcacgcgcgtggtattttcaattataatgtcggtttgatcccttatagacatcctattgttactgttgttggaaagcctattccagtacctaaaatgaagcctggtcaaacagaacccactcaggagcaattgttggaaacgcaagcattgtatatcgaggagttggagtccatctacaacaagtacaaggatgtgtatgcaaaggatcgaaagcaagatttgcgtattgttagctag

SEQ ID NO: 234 - protein, 369 aa, Mucor circinelloides
MKEPVSKENTDTKSDRKIALPDIKKVSQVIPNVPEVQWAPLTGIPFERRIQMAVVLMWIFLLGNCLTLFCCSLFLPFLWPLHIAYIIYLYRDQSAENGGRRSDWFRRLPIWNYYAGYFPAKLVKEQDLDPKKNYVFGSHPHGIISISSFASFATEATGFSQLFPGIIPSLLTLTTNFKFPIYRDIILALGIASVSRHSCEKILSSGPGRSIVIVIGGASESLNARPGIADLVLKKRLGFIRIAIRHGADLVPVFSFGENELYEQVDNSTGSWLWKAQKKMQQALGFTMPLFHARGIFNYNVGLIPYRHPIVTVVGKPIPVPKMKPGQTEPTQEQLLETQALYIEELESIYNKYKDVYAKDRKQDLRIVS

SEQ ID NO: 235 - DNA, 27 bp, Artificial Sequence
  primer for TD DGAT2a
agcggccgcagtatgagagatacggag

SEQ ID NO: 236 - DNA, 23 bp, Artificial Sequence
  primer for TD DGAT2a
tgcggccgctaaccggcaatctg

SEQ ID NO: 237 - DNA, 4895 bp, Artificial Sequence
  plasmid pKR1295
aattcaggagcggccgcagtatgagagatacggagtttgagcagaaattacgtcaacgaactagggtcgatagaacggagcccacgaagcctgtcagtggtagtacaactcctgatacttctcttccagaggacgatgacaaggctaaggccaaagggggattctttaattctttgcgcgatgagatgtcctcatatcggtcggataggggaaggaaatccagtgatggacagttcggtgaggaaggtttggtccctcattatgggcttcctaggttagatgcttgttgttcaattcagactccaatgcgtagaagactgcagactgcgattgtggcatggcacatctcatcgtttgtgtttttagctgtactttcgatctatgcgttatcaaatccgatgctgtggtttgcgtctattccttatactatttattttatcttcgatagagcacctgggaatggtggtgtggttaagaggcgatcacattggtttaggtccttgcccatttggacttggtattgtgagtattttcctatcaacttagataagaccgtaccattaacaccaacttacacagagaagaagccatcaccgagtgaaaatactaagaaatcatcgatctttaacccaaagtcctggaaactcttcaggcgaagtgaaaagtatgaacggaccggcccgcgctacatctttggttaccatcctcatggtatcggggctctgggagcttttggtgccattggtactgaaggttgtggctggtccaagaagtttccaggtataaatgtctccttgatgacgttggtggcacagtttcatgttccattgtacagggattacttattagcgttgggaatcagcgcagtcacaaggaaaaactctttgaaagtactcgagcggaaccactccatttgtattgtcgtcggtggagctagagagtcactgatgagcagtattggttcagtggatttagtactgaaaagaaggaaggggtttattaggcttgctttagagagcggtaacgtatccttagtccctgtctttgggtttggtgaaactgattgttacaacatcgttcatacaagtgagaactcgttctctcataaagttcaactctggatgaaaaagaactacggttttaccatcccaatattttacgctcgtggactgttcaattacgacttcggtttccttccatttaggacccccatcacagtactgacaggcaatccgatctatgtggaaaagaaaataccaaacccaacacaggaacaagtagatcattaccacgatctgtacgttgaggaactaaagaagctctattacgataatagacataagtacggttacggtacagtagagatgcagattgccggttagcggccgcacctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcag

SEQ ID NO: 238 - DNA, 8457 bp, Artificial Sequence
  plasmid pKR1324
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcagtatgagagatacggagtttgagcagaaattacgtcaacgaactagggtcgatagaacggagcccacgaagcctgtcagtggtagtacaactcctgatacttctcttccagaggacgatgacaaggctaaggccaaagggggattctttaattctttgcgcgatgagatgtcctcatatcggtcggataggggaaggaaatccagtgatggacagttcggtgaggaaggtttggtccctcattatgggcttcctaggttagatgcttgttgttcaattcagactccaatgcgtagaagactgcagactgcgattgtggcatggcacatctcatcgtttgtgtttttagctgtactttcgatctatgcgttatcaaatccgatgctgtggtttgcgtctattccttatactatttattttatcttcgatagagcacctgggaatggtggtgtggttaagaggcgatcacattggtttaggtccttgcccatttggacttggtattgtgagtattttcctatcaacttagataagaccgtaccattaacaccaacttacacagagaagaagccatcaccgagtgaaaatactaagaaatcatcgatctttaacccaaagtcctggaaactcttcaggcgaagtgaaaagtatgaacggaccggcccgcgctacatctttggttaccatcctcatggtatcggggctctgggagcttttggtgccattggtactgaaggttgtggctggtccaagaagtttccaggtataaatgtctccttgatgacgttggtggcacagtttcatgttccattgtacagggattacttattagcgttgggaatcagcgcagtcacaaggaaaaactctttgaaagtactcgagcggaaccactccatttgtattgtcgtcggtggagctagagagtcactgatgagcagtattggttcagtggatttagtactgaaaagaaggaaggggtttattaggcttgctttagagagcggtaacgtatccttagtccctgtctttgggtttggtgaaactgattgttacaacatcgttcatacaagtgagaactcgttctctcataaagttcaactctggatgaaaaagaactacggttttaccatcccaatattttacgctcgtggactgttcaattacgacttcggtttccttccatttaggacccccatcacagtactgacaggcaatccgatctatgtggaaaagaaaataccaaacccaacacaggaacaagtagatcattaccacgatctgtacgttgaggaactaaagaagctctattacgataatagacataagtacggttacggtacagtagagatgcagattgccggttagc

SEQ ID NO: 239 - DNA, 27 bp, Artificial Sequence
  primer for TD DGAT2b
agcggccgcagtatgagagatacggaa

SEQ ID NO: 240 - DNA, 28 bp, Artificial Sequence
  primer for TD DGAT2b
tgcggccgcttaaccggcaatttgcatc

SEQ ID NO: 241 - DNA, 4896 bp, Artificial Sequence
  plasmid pKR1296
aattcaggagcggccgcagtatgagagatacggaatttgagcagaaattacgccagcgaactagggtcgatagaacggagcttacgaagcctgtcagtggtagtacgactcctgacacttctcttccggaggacgatgacaaggccaaagccaaaggggggttctttaattctttgcgcgatgagatgtcctcatatcggtcggataggagtaggaaatctagtggtggacagttcggtgaggaaggtttggtccctcattatgggcttcctaggttggatgcatgttgttcaattcagactccaatgcgtagaagattgcagactgcggttgtggcatggcacatctcatcgtttgtgtttttagctgtgctttcgatctatgcgttatcaaatccgatgctgtggtttgcgtctattccttatacgatttattttatcttcgatagagcacctgggaatggtggtgtggttaagaggggatcgcattggtttaggtccttgcccatttggacttggtattgtgagtattttcctatcaacttagataggaccacaccattaaaaccaacttacacagagaagaaaccatcaccgagtgaaaagactaaaaaatcatcgatttttaacccaaagtcctggaaactctttaggcgaactgaaaagtatgaactgaccggtccgcgctacatctttggttaccatcctcatggtatcggggctctgggagctttcggtgccattggtactgaaggttgtggctggtccaagaagtttccaggtataaatgtctccttgatgacgttggttgcacagtttcatgtcccattgtacagggattacttattagcgttgggaattagtgcagtcacaaggaaaaactctttgaaagttctcgagaggaaccactccatttgtattgtcgtcggtggagctagagagtcactgatgagcagtattggttcagtggatttattactgaaaagaaggaaggggtttattaggcttgctttagagagcggtaacgtatccttagttcctgtctttgggtttggtgaaactgattgttacaacatcgtacatacaagtgagaactctttctctcataaggtccaactctggatgaagaagaactacggttttaccatcccaatattctacgctcgtggactgttcaattacgacttcggtttccttccatttaggacgcccatcacagtactgacaggcaatccgatctatgtggaaaagaaaatatcaaacccaacaccggaacaagtagatcattaccacgatctgtacgttgaggaactaaagaagctctattacgataatagacacaagtacggttacggtacagtagagatgcaaattgccggttaagcggccgcacctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcag

SEQ ID NO: 242 - DNA, 8458 bp, Artificial Sequence
  plasmid pKR1325
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcagtatgagagatacggaatttgagcagaaattacgccagcgaactagggtcgatagaacggagcttacgaagcctgtcagtggtagtacgactcctgacacttctcttccggaggacgatgacaaggccaaagccaaaggggggttctttaattctttgcgcgatgagatgtcctcatatcggtcggataggagtaggaaatctagtggtggacagttcggtgaggaaggtttggtccctcattatgggcttcctaggttggatgcatgttgttcaattcagactccaatgcgtagaagattgcagactgcggttgtggcatggcacatctcatcgtttgtgtttttagctgtgctttcgatctatgcgttatcaaatccgatgctgtggtttgcgtctattccttatacgatttattttatcttcgatagagcacctgggaatggtggtgtggttaagaggggatcgcattggtttaggtccttgcccatttggacttggtattgtgagtattttcctatcaacttagataggaccacaccattaaaaccaacttacacagagaagaaaccatcaccgagtgaaaagactaaaaaatcatcgatttttaacccaaagtcctggaaactctttaggcgaactgaaaagtatgaactgaccggtccgcgctacatctttggttaccatcctcatggtatcggggctctgggagctttcggtgccattggtactgaaggttgtggctggtccaagaagtttccaggtataaatgtctccttgatgacgttggttgcacagtttcatgtcccattgtacagggattacttattagcgttgggaattagtgcagtcacaaggaaaaactctttgaaagttctcgagaggaaccactccatttgtattgtcgtcggtggagctagagagtcactgatgagcagtattggttcagtggatttattactgaaaagaaggaaggggtttattaggcttgctttagagagcggtaacgtatccttagttcctgtctttgggtttggtgaaactgattgttacaacatcgtacatacaagtgagaactctttctctcataaggtccaactctggatgaagaagaactacggttttaccatcccaatattctacgctcgtggactgttcaattacgacttcggtttccttccatttaggacgcccatcacagtactgacaggcaatccgatctatgtggaaaagaaaatatcaaacccaacaccggaacaagtagatcattaccacgatctgtacgttgaggaactaaagaagctctattacgataatagacacaagtacggttacggtacagtagagatgcaaattgccggttaagc

SEQ ID NO: 243 - DNA, 26 bp, Artificial Sequence
  primer for DH DGAT2
agcggccgcaccatgtcacagaactc

SEQ ID NO: 244 - DNA, 32 bp, Artificial Sequence
  primer for DH DGAT2
tgcggccgctattcaataataattaattcaac

SEQ ID NO: 245 - DNA, 5561 bp, Artificial Sequence
  plasmid pKR1297
aattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacgcgttagaatactcaagctatgcatcaagcttggtaccgagctcggatccactagtaacggccgccagtgtgctggaattcaggagcggccgcaccatgtcacagaactcattggatgaaaaaaataccacatctgacgataagaaacaacagttacggaggagacatggttcacacgatacaccatcagaaaatggcttgagaactccttctcggtctagcaccaaatccaattccaagccaaagtcacataggaagaagtcacttgtcaattttgcaccgttgaatactccgttacataataggttagaaactatgggggtaatctggcattgtctttccattccttttttcgtgagtctattcttattggcaatttcattaggctggatcatctggatatttgtgatccttccttactttatttggtggtatttctttgatttacatacacctacaaatggtaaaactgtctaccgggttaaagattggatgcagaatatcatagtctgggaatggtttgtgaactattttcctattagtatccataaggcatgcgatctcgaaccaacttttacgcaaatgcttgttgatgataatgaaggaaatgacgacgaagaagacctaatttcagaggattcaagaacaattattgataaattgttcaaaacattgggattgagaaaacgtttgaatgattcagattcgcataatgttctgaatacaccatcaagtgataaaaaatttgataaagctttgaaatataaaaaagaaagtactgggcctaggtatattttcggctaccacccgcacggtgtaatttctatgggagtcatgggagcttttgcaactaatgtaattcggaatgaaccatatcagcctccttttagtttcttaaagtcatttttccatgatccatctaagtacactagattattaccgggtattggcaatatctttcctttgactttaactactcaatttaccttacccttttaccgcgactatttaatgagcttgggattgacaagtgcatcttacaaaaacattaaaagtattattaataatggagataattctgtttgtcttgtcgttggtggtgcccaggaatcattgcttaataccatggtttcaccaaggcttagaatcggcaatggatataagaatgatgaaactgatgaaagtggagatgaatcagaacctatggtaaaggagtataatccgaaggaagtagaacattatagcattaaagaacaaatggatgaaaatttagatgagaacaaacatgaatccagcgaaagtgacagcaatctggacaccgaaaaaggccaagaaaaactcgatagcgaaaagcttattaaaactgagactgacaacgctgatcaacccggagaaaataaagataaaaacctcaatgatcataatgaaacagaaactgaaaaaccgggacaaagcgaagaaaaagaaagccaggatgatgactcctcaagtccaaggcaaattcagttggtattgaataagcggaaaggttttgttaaattagctattgaattaggcaatgtttgtttggtgccaacatttggatttggtgaggcagatatttatagaatagctaacccaaaaccgggatctcttggatcaagatttcaagaatggatgaaatctacatttcagtttacagtgccatttttcagtgccagaggtgtttttatatatgattttgggtttttaccatttagaaatcccattgatatatgcatgggtgagccaatttatgtcccgagtggactaattgcggactacaaattaaaacaccctggctttgattctgatgaagaagtagaacaaaacaacaagcaaaaaaaggaagatgaaaaaggagatgaaaccgattctaaaaagaaggacaagaaggattttaaaaagaaaggcaaaaaggattttaaaactgaaaaaaaagaggattctaaatcgaaagacaaaaagagagaaaaaaaaataaagattccttccgaaatactcaaccattaccataagttatacgtggatgggttgaagaaagtctatgaagaaaacaagtgtaagtttggttatgaagatgttgaattaattattattgaatagcggccgcacctg

SEQ ID NO: 246 - DNA, 4480 bp, Artificial Sequence
  plasmid pKR179
ctagacctgcaggatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacctgcaggtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgact

SEQ ID NO: 247 - DNA, 6519 bp, Artificial Sequence
  plasmid pKR1327
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacctgcaggtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagacctgcaggatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgtcacagaactcattggatgaaaaaaataccacatctgacgataagaaacaacagttacggaggagacatggttcacacgatacaccatcagaaaatggcttgagaactccttctcggtctagcaccaaatccaattccaagccaaagtcacataggaagaagtcacttgtcaattttgcaccgttgaatactccgttacataataggttagaaactatgggggtaatctggcattgtctttccattccttttttcgtgagtctattcttattggcaatttcattaggctggatcatctggatatttgtgatccttccttactttatttggtggtatttctttgatttacatacacctacaaatggtaaaactgtctaccgggttaaagattggatgcagaatatcatagtctgggaatggtttgtgaactattttcctattagtatccataaggcatgcgatctcgaaccaacttttacgcaaatgcttgttgatgataatgaaggaaatgacgacgaagaagacctaatttcagaggattcaagaacaattattgataaattgttcaaaacattgggattgagaaaacgtttgaatgattcagattcgcataatgttctgaatacaccatcaagtgataaaaaatttgataaagctttgaaatataaaaaagaaagtactgggcctaggtatattttcggctaccacccgcacggtgtaatttctatgggagtcatgggagcttttgcaactaatgtaattcggaatgaaccatatcagcctccttttagtttcttaaagtcatttttccatgatccatctaagtacactagattattaccgggtattggcaatatctttcctttgactttaactactcaatttaccttacccttttaccgcgactatttaatgagcttgggattgacaagtgcatcttacaaaaacattaaaagtattattaataatggagataattctgtttgtcttgtcgttggtggtgcccaggaatcattgcttaataccatggtttcaccaaggcttagaatcggcaatggatataagaatgatgaaactgatgaaagtggagatgaatcagaacctatggtaaaggagtataatccgaaggaagtagaacattatagcattaaagaacaaatggatgaaaatttagatgagaacaaacatgaatccagcgaaagtgacagcaatctggacaccgaaaaaggccaagaaaaactcgatagcgaaaagcttattaaaactgagactgacaacgctgatcaacccggagaaaataaagataaaaacctcaatgatcataatgaaacagaaactgaaaaaccgggacaaagcgaagaaaaagaaagccaggatgatgactcctcaagtccaaggcaaattcagttggtattgaataagcggaaaggttttgttaaattagctattgaattaggcaatgtttgtttggtgccaacatttggatttggtgaggcagatatttatagaatagctaacccaaaaccgggatctcttggatcaagatttcaagaatggatgaaatctacatttcagtttacagtgccatttttcagtgccagaggtgtttttatatatgattttgggtttttaccatttagaaatcccattgatatatgcatgggtgagccaatttatgtcccgagtggactaattgcggactacaaattaaaacaccctggctttgattctgatgaagaagtagaacaaaacaacaagcaaaaaaaggaagatgaaaaaggagatgaaaccgattctaaaaagaaggacaagaaggattttaaaaagaaaggcaaaaaggattttaaaactgaaaaaaaagaggattctaaatcgaaagacaaaaagagagaaaaaaaaataaagattccttccgaaatactcaaccattaccataagttatacgtggatgggttgaagaaagtctatgaagaaaacaagtgtaagtttggttatgaagatgttgaattaattattattgaatagc

SEQ ID NO: 248 - DNA, 5303 bp, Artificial Sequence
  plasmid pKR325
agcttggatctcctgcaggatctggccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgcca

SEQ ID NO: 249 - DNA, 9122 bp, Artificial Sequence
  plasmid pKR1328
ggatctggccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgtcacagaactcattggatgaaaaaaataccacatctgacgataagaaacaacagttacggaggagacatggttcacacgatacaccatcagaaaatggcttgagaactccttctcggtctagcaccaaatccaattccaagccaaagtcacataggaagaagtcacttgtcaattttgcaccgttgaatactccgttacataataggttagaaactatgggggtaatctggcattgtctttccattccttttttcgtgagtctattcttattggcaatttcattaggctggatcatctggatatttgtgatccttccttactttatttggtggtatttctttgatttacatacacctacaaatggtaaaactgtctaccgggttaaagattggatgcagaatatcatagtctgggaatggtttgtgaactattttcctattagtatccataaggcatgcgatctcgaaccaacttttacgcaaatgcttgttgatgataatgaaggaaatgacgacgaagaagacctaatttcagaggattcaagaacaattattgataaattgttcaaaacattgggattgagaaaacgtttgaatgattcagattcgcataatgttctgaatacaccatcaagtgataaaaaatttgataaagctttgaaatataaaaaagaaagtactgggcctaggtatattttcggctaccacccgcacggtgtaatttctatgggagtcatgggagcttttgcaactaatgtaattcggaatgaaccatatcagcctccttttagtttcttaaagtcatttttccatgatccatctaagtacactagattattaccgggtattggcaatatctttcctttgactttaactactcaatttaccttacccttttaccgcgactatttaatgagcttgggattgacaagtgcatcttacaaaaacattaaaagtattattaataatggagataattctgtttgtcttgtcgttggtggtgcccaggaatcattgcttaataccatggtttcaccaaggcttagaatcggcaatggatataagaatgatgaaactgatgaaagtggagatgaatcagaacctatggtaaaggagtataatccgaaggaagtagaacattatagcattaaagaacaaatggatgaaaatttagatgagaacaaacatgaatccagcgaaagtgacagcaatctggacaccgaaaaaggccaagaaaaactcgatagcgaaaagcttattaaaactgagactgacaacgctgatcaacccggagaaaataaagataaaaacctcaatgatcataatgaaacagaaactgaaaaaccgggacaaagcgaagaaaaagaaagccaggatgatgactcctcaagtccaaggcaaattcagttggtattgaataagcggaaaggttttgttaaattagctattgaattaggcaatgtttgtttggtgccaacatttggatttggtgaggcagatatttatagaatagctaacccaaaaccgggatctcttggatcaagatttcaagaatggatgaaatctacatttcagtttacagtgccatttttcagtgccagaggtgtttttatatatgattttgggtttttaccatttagaaatcccattgatatatgcatgggtgagccaatttatgtcccgagtggactaattgcggactacaaattaaaacaccctggctttgattctgatgaagaagtagaacaaaacaacaagcaaaaaaaggaagatgaaaaaggagatgaaaccgattctaaaaagaaggacaagaaggattttaaaaagaaaggcaaaaaggattttaaaactgaaaaaaaagaggattctaaatcgaaagacaaaaagagagaaaaaaaaataaagattccttccgaaatactcaaccattaccataagttatacgtggatgggttgaagaaagtctatgaagaaaacaagtgtaagtttggttatgaagatgttgaattaattattattgaatagcggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacctgca

SEQ ID NO: 250 - DNA, 8084 bp, Artificial Sequence
  plasmid pMDGAT2-17
catggcgctctttgcgcctttacggatgcccgtcaagcgtcgtatgcagacaggagctgtcctatactggattgcggggatgatttactgcattggcatctttgccttcctctgcacgttcaagatccttcgacccttgatcatcatctatgtcctgtgggcctacatgctcgaccgagcaccagagcggggtgcacgcacagtccaatggtattgtaactggatcggatggaaacactttgcacagtactttcctatgacccttgtcaaggagggagagctggatccatccaagaactacatctttgggtatcacccacacggaatcatttccttgggtgccctctgcgcctttgggaccgagggccttcatttctccaaacgcttcccgggtatcaagcctcatctgctcaccattcacgccaactttcagatcccactctatcgcgatatgatcatggcccacggctgtgcttccgtgtcgagggcctcttgtgaacacatcctgcggtctggcgaaggatcctcggtcgtgatcgttgtcgggggtgcacaagaaagtttgtcgactcaacctggcacgttaaatctgacactcaagaaaagactgggattttgcaagctggcctttgtcaatggcgcaagtctggtacctacgttggcctttggtgagaacgagctctatgaggtgtaccacaccaagcccacaagcctgatatacaagctccagcagttgactaaacgcacgatcggcttcacaatgcccgtgttcaacggacgaggaatcttcaattatgagtttggactgctgccaaggaggaagcctgtctatatcgttataggaaaccccattcatgtagacaaggtcgagaacccaacgattgaacagatgcagaaactgcagtcaatttacattgatgaggtgctaaacatttgggaaagatacaaggacaagtatgccgcaggacgaactcaggaactgtgcatcatcgaataggcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctc

SEQ ID NO: 251 - DNA, 29 bp, Artificial Sequence
  primer for Mortierella alpina DGAT2
tgcggccgcaccatgccgctctttgcgcc

SEQ ID NO: 252 - DNA, 29 bp, Artificial Sequence
  primer for Mortierella alpina DGAT2
agcggccgctattcgatgatgcacagttc

SEQ ID NO: 253 - DNA, 4529 bp, Artificial Sequence
  plasmid pKR1330
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggtgcggccgcaccatgccgctctttgcgcctttacggatgcccgtcaagcgtcgtatgcagacaggagctgtcctatactggattgcggggatgatttactgcattggcatctttgccttcctctgcacgttcaagatccttcgacccttgatcatcatctatgtcctgtgggcctacatgctcgaccgagcaccagagcggggtgcacgcacagtccaatggtatcgtaactggatcggatggaaacactttgcacagtactttcctatgacccttgtcaaggagggagggctggatccatccaagaactacatctttggctatcacccacacggaatcatttccttgggtgccctctgcgcctttgggaccgagggccttcatttctccaaacgcttcccgggtatcaagcctcatctgctcaccattcacgccaactttcagatcccactctatcgcgatatgatcatggcccacggctgtgcttccgtgtcgagggcctcttgtgaacacatcctgcggtctggcgaaggatcctcggtcgtgatcgttgtcgggggtgcacaagaaagtttgtcgactcaacctggcacgttaaatctgacactcaagaaaagactgggattttgcaagctggcccttgtcaatggcgcaagtctggtacctacgttggcctttggcgagaacgagctctatgaggtgtaccacaccaagcccacaagcctgatatacaagctccagcagttgactaaacgcacgatcggcttcacaatgcccgtgttcaacggacgaggaatcttcaattatgagtttggactgctgccaaggaggaagcctgtctatatcgttataggaaaccccattcatgtagacaaggtcgagaacccaacgattgaacagatgcagaaactgcagtcaatttacattgatgaggtgctaaacatttgggaaagatacaaggacaagtatgccgcaggacgaactcaggaactgtgcatcatcgaatagcggccgctcctg

SEQ ID NO: 254 - DNA, 996 bp, Mortierella alpina
atgccgctctttgcgcctttacggatgcccgtcaagcgtcgtatgcagacaggagctgtcctatactggattgcggggatgatttactgcattggcatctttgccttcctctgcacgttcaagatccttcgacccttgatcatcatctatgtcctgtgggcctacatgctcgaccgagcaccagagcggggtgcacgcacagtccaatggtatcgtaactggatcggatggaaacactttgcacagtactttcctatgacccttgtcaaggagggagggctggatccatccaagaactacatctttggctatcacccacacggaatcatttccttgggtgccctctgcgcctttgggaccgagggccttcatttctccaaacgcttcccgggtatcaagcctcatctgctcaccattcacgccaactttcagatcccactctatcgcgatatgatcatggcccacggctgtgcttccgtgtcgagggcctcttgtgaacacatcctgcggtctggcgaaggatcctcggtcgtgatcgttgtcgggggtgcacaagaaagtttgtcgactcaacctggcacgttaaatctgacactcaagaaaagactgggattttgcaagctggcccttgtcaatggcgcaagtctggtacctacgttggcctttggcgagaacgagctctatgaggtgtaccacaccaagcccacaagcctgatatacaagctccagcagttgactaaacgcacgatcggcttcacaatgcccgtgttcaacggacgaggaatcttcaattatgagtttggactgctgccaaggaggaagcctgtctatatcgttataggaaaccccattcatgtagacaaggtcgagaacccaacgattgaacagatgcagaaactgcagtcaatttacattgatgaggtgctaaacatttgggaaagatacaaggacaagtatgccgcaggacgaactcaggaactgtgcatcatcgaatag

SEQ ID NO: 255 - protein, 331 aa, Mortierella alpina
MPLFAPLRMPVKRRMQTGAVLYWIAGMIYCIGIFAFLCTFKILRPLIIIYVLWAYMLDRAPERGARTVQWYRNWIGWKHFAQYFPMTLVKEGGLDPSKNYIFGYHPHGIISLGALCAFGTEGLHFSKRFPGIKPHLLTIHANFQIPLYRDMIMAHGCASVSRASCEHILRSGEGSSVVIVVGGAQESLSTQPGTLNLTLKKRLGFCKLALVNGASLVPTLAFGENELYEVYHTKPTSLIYKLQQLTKRTIGFTMPVFNGRGIFNYEFGLLPRRKPVYIVIGNPIHVDKVENPTIEQMQKLQSIYIDEVLNIWERYKDKYAAGRTQELCIIE

SEQ ID NO: 256 - DNA, 8091 bp, Artificial Sequence
  plasmid pKR1335
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgccgctctttgcgcctttacggatgcccgtcaagcgtcgtatgcagacaggagctgtcctatactggattgcggggatgatttactgcattggcatctttgccttcctctgcacgttcaagatccttcgacccttgatcatcatctatgtcctgtgggcctacatgctcgaccgagcaccagagcggggtgcacgcacagtccaatggtatcgtaactggatcggatggaaacactttgcacagtactttcctatgacccttgtcaaggagggagggctggatccatccaagaactacatctttggctatcacccacacggaatcatttccttgggtgccctctgcgcctttgggaccgagggccttcatttctccaaacgcttcccgggtatcaagcctcatctgctcaccattcacgccaactttcagatcccactctatcgcgatatgatcatggcccacggctgtgcttccgtgtcgagggcctcttgtgaacacatcctgcggtctggcgaaggatcctcggtcgtgatcgttgtcgggggtgcacaagaaagtttgtcgactcaacctggcacgttaaatctgacactcaagaaaagactgggattttgcaagctggcccttgtcaatggcgcaagtctggtacctacgttggcctttggcgagaacgagctctatgaggtgtaccacaccaagcccacaagcctgatatacaagctccagcagttgactaaacgcacgatcggcttcacaatgcccgtgttcaacggacgaggaatcttcaattatgagtttggactgctgccaaggaggaagcctgtctatatcgttataggaaaccccattcatgtagacaaggtcgagaacccaacgattgaacagatgcagaaactgcagtcaatttacattgatgaggtgctaaacatttgggaaagatacaaggacaagtatgccgcaggacgaactcaggaactgtgcatcatcgaatagc

SEQ ID NO: 257 - DNA, 30 bp, Artificial Sequence
  primer for Pichia anomala DGAT2
agcggccgcaccatgatgcctgcaaaagac

SEQ ID NO: 258 - DNA, 29 bp, Artificial Sequence
  primer for Pichia anomala DGAT2
tgcggccgcttactccactatttttaacg

SEQ ID NO: 259 - DNA, 4824 bp, Artificial Sequence
  plasmid pKR1319
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaccatgatgcctgcaaaagacttgttagagagtaacgagctatcgcaaatttctgacgaggatgagttcccttcaaaaaatccagacaatgatgcttcaagtcttgaaaagaacatagttgtgccaaatgatggtcgagtgtttaagaaggcagatccaaaaagaacaaggggatcctctattggaaacgtcagagtcgctccattatctacacctctaccaagaagactacaaactgctgctgtcttgtggcataccatttcaattcctgttttcattactattttcttcatctcattagccattcccatcttttggttgattgcggttccgtatttattctacttattcacagatcgcacaccttcaaatggccaggtcaccaaaagatattcggagagattcagaaaattgagtgtttggaagtatttttgcaattattatccagtcaagctattcaagactcataatttagaaccaactttcacagaagtggaaattaaagatgattattacagattgccaccacctttgagttaccttttcaaaatcaataaaaaaccttacaagaagcttcaaaagactggtcctaaatatatatttggcctgcatccccatggtgttgtttccttgagtggatttggtggtattggaactgacggagctaattggtctaagctgtttcctggaattccagtatgtttattgacacttttgaaccaattctatatcccactttatagagattaccttttggcccttggtataacttcagcaggtcgtaataatgccctcaaaatattgaagcaaggattctccttagcaattgtcgttggtggcgcccaagaatctttattagcaagacctgaatctactgagattgtacttcaaaagagaaaaggattcatcaaattagctcttgaaacaggaaatgtatcacttgttccttgttattgttttggtgaaaatgaactatacaatatcttagaaccagatgaggactcctattggagaaagctgcaactctggttgaaaaaaagttttggatttacaatcccatttttccatgcaaggggtgtctttaattatgattttgggttattgcccttcagaaaagaagttacccttgttacagggaaaccaatacctgttccatttcttccaagtccaaaaaagactgaagttgattactaccatgagctttacgtgaacgagttgcaaagaattttcgatgaatacaagaccaaatttcaagaagatggccaaaacagtacgttaaaaatagtggagtaagcggccgcacctg

SEQ ID NO: 260 - DNA, 8386 bp, Artificial Sequence
  plasmid pKR1332
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgatgcctgcaaaagacttgttagagagtaacgagctatcgcaaatttctgacgaggatgagttcccttcaaaaaatccagacaatgatgcttcaagtcttgaaaagaacatagttgtgccaaatgatggtcgagtgtttaagaaggcagatccaaaaagaacaaggggatcctctattggaaacgtcagagtcgctccattatctacacctctaccaagaagactacaaactgctgctgtcttgtggcataccatttcaattcctgttttcattactattttcttcatctcattagccattcccatcttttggttgattgcggttccgtatttattctacttattcacagatcgcacaccttcaaatggccaggtcaccaaaagatattcggagagattcagaaaattgagtgtttggaagtatttttgcaattattatccagtcaagctattcaagactcataatttagaaccaactttcacagaagtggaaattaaagatgattattacagattgccaccacctttgagttaccttttcaaaatcaataaaaaaccttacaagaagcttcaaaagactggtcctaaatatatatttggcctgcatccccatggtgttgtttccttgagtggatttggtggtattggaactgacggagctaattggtctaagctgtttcctggaattccagtatgtttattgacacttttgaaccaattctatatcccactttatagagattaccttttggcccttggtataacttcagcaggtcgtaataatgccctcaaaatattgaagcaaggattctccttagcaattgtcgttggtggcgcccaagaatctttattagcaagacctgaatctactgagattgtacttcaaaagagaaaaggattcatcaaattagctcttgaaacaggaaatgtatcacttgttccttgttattgttttggtgaaaatgaactatacaatatcttagaaccagatgaggactcctattggagaaagctgcaactctggttgaaaaaaagttttggatttacaatcccatttttccatgcaaggggtgtctttaattatgattttgggttattgcccttcagaaaagaagttacccttgttacagggaaaccaatacctgttccatttcttccaagtccaaaaaagactgaagttgattactaccatgagctttacgtgaacgagttgcaaagaattttcgatgaatacaagaccaaatttcaagaagatggccaaaacagtacgttaaaaatagtggagtaagc

SEQ ID NO: 261 - DNA, 31 bp, Artificial Sequence
  primer for Rhodotorula glutinis DGAT2
tgcggccgcaccatgggcgcacaagaagagg

SEQ ID NO: 262 - DNA, 27 bp, Artificial Sequence
  primer for Rhodotorula glutinis DGAT2
gcggccgctcacgcgatgatggtgagc

SEQ ID NO: 263 - DNA, 4573 bp, Artificial Sequence
  plasmid pHD28
cctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggtgcggccgcaccatgggcgcacaagaagaggtcgaatacgaccagtcggagcactccaagatcaagttcgtgccctttgtcgtgccacggcatcgtcgccttcagaccttctcggtgtttctctggacgaccgcgctccccatctcgctcggcatcttctgcatcctctgctcattccctcctctctggccgctcgtcatcgggtacctcacctgggtgttcctcatcgaccaggcgccaatgcgcggcgggagaccgcaagcgtggctgcgcaagtcgcgcgtctgggagtggttcgccggctactacccggtcagcctcatcaagagcgccgacctcccgcccgaccagcgctacgtctttgggtaccaccctcacggcgtcatcggcatgggcgccatcgccaactttggcaccgacgcgactgggttctcgcgcctgttcccgggcatcacgccgcacctcctcacgctcgcgagcaacttcaagctgcccgtgtaccgcgagctcctcctcggcctcggcatctcgtccgtctcgatgaagagctgccagaacatcctgcggcaaggtcccggctcttccatcacgatcgtcgtcggcggcgcagctgagagcctgagcgcgcaccccggaacggccgacctgacgctcaagcggcgcaagggcttcatcaagctcgcgatccgcaccggcgcctcgctcgtgcccgtcttttcctttggcgagaacgacatcttcaaccagttgtcgaacgagcgagggacgcgcctgtacaagctccaaaagcggttccaggccgtctttggcttcactctgcccatcttcttcggccgcggcttgttcaactacaacatgggcctgatgccgtatcgacacccgattgtctcggtcgtcggtcgcccgatcaaggtcaagcagaaggaccacccttcgactgccgacctcgaggaggtgcaggagcgctacatcgccgagctcaagaggatctgggaggactacaaggaggtgtacgccaagagccgcaccaaggagctcaccatcatcgcgtgagcggccgc

SEQ ID NO: 264 - DNA, 1041 bp, Rhodotorula glutinis
atgggcgcacaagaagaggtcgaatacgaccagtcggagcactccaagatcaagttcgtgccctttgtcgtgccacggcatcgtcgccttcagaccttctcggtgtttctctggacgaccgcgctccccatctcgctcggcatcttctgcatcctctgctcattccctcctctctggccgctcgtcatcgggtacctcacctgggtgttcctcatcgaccaggcgccaatgcgcggcgggagaccgcaagcgtggctgcgcaagtcgcgcgtctgggagtggttcgccggctactacccggtcagcctcatcaagagcgccgacctcccgcccgaccagcgctacgtctttgggtaccaccctcacggcgtcatcggcatgggcgccatcgccaactttggcaccgacgcgactgggttctcgcgcctgttcccgggcatcacgccgcacctcctcacgctcgcgagcaacttcaagctgcccgtgtaccgcgagctcctcctcggcctcggcatctcgtccgtctcgatgaagagctgccagaacatcctgcggcaaggtcccggctcttccatcacgatcgtcgtcggcggcgcagctgagagcctgagcgcgcaccccggaacggccgacctgacgctcaagcggcgcaagggcttcatcaagctcgcgatccgcaccggcgcctcgctcgtgcccgtcttttcctttggcgagaacgacatcttcaaccagttgtcgaacgagcgagggacgcgcctgtacaagctccaaaagcggttccaggccgtctttggcttcactctgcccatcttcttcggccgcggcttgttcaactacaacatgggcctgatgccgtatcgacacccgattgtctcggtcgtcggtcgcccgatcaaggtcaagcagaaggaccacccttcgactgccgacctcgaggaggtgcaggagcgctacatcgccgagctcaagaggatctgggaggactacaaggaggtgtacgccaagagccgcaccaaggagctcaccatcatcgcgtga

SEQ ID NO: 265 - protein, 346 aa, Rhodotorula glutinis
MGAQEEVEYDQSEHSKIKFVPFVVPRHRRLQTFSVFLWTTALPISLGIFCILCSFPPLWPLVIGYLTWVFLIDQAPMRGGRPQAWLRKSRVWEWFAGYYPVSLIKSADLPPDQRYVFGYHPHGVIGMGAIANFGTDATGFSRLFPGITPHLLTLASNFKLPVYRELLLGLGISSVSMKSCQNILRQGPGSSITIVVGGAAESLSAHPGTADLTLKRRKGFIKLAIRTGASLVPVFSFGENDIFNQLSNERGTRLYKLQKRFQAVFGFTLPIFFGRGLFNYNMGLMPYRHPIVSVVGRPIKVKQKDHPSTADLEEVQERYIAELKRIWEDYKEVYAKSRTKELTIIA

SEQ ID NO: 266 - DNA, 8137 bp, Artificial Sequence
  plasmid pKR1333
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgggcgcacaagaagaggtcgaatacgaccagtcggagcactccaagatcaagttcgtgccctttgtcgtgccacggcatcgtcgccttcagaccttctcggtgtttctctggacgaccgcgctccccatctcgctcggcatcttctgcatcctctgctcattccctcctctctggccgctcgtcatcgggtacctcacctgggtgttcctcatcgaccaggcgccaatgcgcggcgggagaccgcaagcgtggctgcgcaagtcgcgcgtctgggagtggttcgccggctactacccggtcagcctcatcaagagcgccgacctcccgcccgaccagcgctacgtctttgggtaccaccctcacggcgtcatcggcatgggcgccatcgccaactttggcaccgacgcgactgggttctcgcgcctgttcccgggcatcacgccgcacctcctcacgctcgcgagcaacttcaagctgcccgtgtaccgcgagctcctcctcggcctcggcatctcgtccgtctcgatgaagagctgccagaacatcctgcggcaaggtcccggctcttccatcacgatcgtcgtcggcggcgcagctgagagcctgagcgcgcaccccggaacggccgacctgacgctcaagcggcgcaagggcttcatcaagctcgcgatccgcaccggcgcctcgctcgtgcccgtcttttcctttggcgagaacgacatcttcaaccagttgtcgaacgagcgagggacgcgcctgtacaagctccaaaagcggttccaggccgtctttggcttcactctgcccatcttcttcggccgcggcttgttcaactacaacatgggcctgatgccgtatcgacacccgattgtctcggtcgtcggtcgcccgatcaaggtcaagcagaaggaccacccttcgactgccgacctcgaggaggtgcaggagcgctacatcgccgagctcaagaggatctgggaggactacaaggaggtgtacgccaagagccgcaccaaggagctcaccatcatcgcgtgagc

SEQ ID NO: 267 - DNA, 31 bp, Artificial Sequence
  primer for Lipomyces starkeyii DGAT2
agcggccgcaccatgcatggcgtcgcagtgc

SEQ ID NO: 268 - DNA, 31 bp, Artificial Sequence
  primer for Lipomyces starkeyii DGAT2
agcggccgcttactccacaaaacgcatctcg

SEQ ID NO: 269 - DNA, 34 bp, Artificial Sequence
  primer for Lipomyces starkeyii DGAT2
agcggccgcaccatgagtgagaaggcagagatcg

SEQ ID NO: 270 - DNA, 4766 bp, Artificial Sequence
  plasmid pHD30
cctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaccatgagtgagaaggcagagatcgaggttccgccgcaaaaatcgacattccctcgcagtgtgcacttcgctccacttcatattccactggagagacgcctacagactttggcagtcttattccacactgtcgcgctaccatactgcatcggtctgttctttctcatgctcgcgttccctcctttttggccattattggtaatgtatgtcatatacgcatacgggttcgaccactcgagctcgaacggagagatctcccgccggcgatcgccgctgtttcgaagactcccgttgttcaggctgtattgtgattacttccccatccacattcaccgggaggttccgctcgagccgacgtttcctggtcgccttcgcgaaccgagtggccttgtcgagcggtggattgcgaagatgttcggcgtgcaggacgctgttgtcgagggaaatgaatctgacgttaaggccacggccaacggcaatgggacgacgaaagaaatcggaccgacgtatgttttcggctatcatccgcatggaattgttagcttgggtgcgtttggtgctattggtacggaaggcgctggatgggagaagctctttcctgggatcccggtgtcactgctgactctcgaaacaaatttcagccttccattttacagagagtatttgctgtcacttgggattgcttcagtatctcgacggtcttgtaccaatctcctcaaacacgaccaatccatctgcatcgttatcggcggcgcccaagagtcgctcttagcggaaccaggcactctagatctgatcctcgttaaacgtcgcggttttgtcaaacttgcaatgtcaacggcgcgggtatctgaccaaccgatttgtcttgttccgatcctcagtttcggcgagaacgacgtgtacgaccaagtccgcggggaccgatcgtcgaagttgtataagatccagacttttatcaagaaagcggccgggtttacgctaccattgatgtatgcgcgcggtatatttaattacgactttgggctgatgccgtaccgcaggcaaatgacgctcgtggtcggcaagccgattgcagtgccgtacgtggcccagcctacggaggctgaaatcgaagtgtatcacaagcagtacatggatgaattgaggaggttatgggacacgtataaggacgactattttgtagaccacaagggcaagggggtcaagaattccgagatgcgttttgtggagtaagcggccgca

SEQ ID NO: 271 - DNA, 1233 bp, Lipomyces starkeyi
atgagtgagaaggcagagatcgaggttccgccgcaaaaatcgacattccctcgcagtgtgcacttcgctccacttcatattccactggagagacgcctacagactttggcagtcttattccacactgtcgcgctaccatactgcatcggtctgttctttctcatgctcgcgttccctcctttttggccattattggtaatgtatgtcatatacgcatacgggttcgaccactcgagctcgaacggagagatctcccgccggcgatcgccgctgtttcgaagactcccgttgttcaggctgtattgtgattacttccccatccacattcaccgggaggttccgctcgagccgacgtttcctggtcgccttcgcgaaccgagtggccttgtcgagcggtggattgcgaagatgttcggcgtgcaggacgctgttgtcgagggaaatgaatctgacgttaaggccacggccaacggcaatgggacgacgaaagaaatcggaccgacgtatgttttcggctatcatccgcatggaattgttagcttgggtgcgtttggtgctattggtacggaaggcgctggatgggagaagctctttcctgggatcccggtgtcactgctgactctcgaaacaaatttcagccttccattttacagagagtatttgctgtcacttgggattgcttcagtatctcgacggtcttgtaccaatctcctcaaacacgaccaatccatctgcatcgttatcggcggcgcccaagagtcgctcttagcggaaccaggcactctagatctgatcctcgttaaacgtcgcggttttgtcaaacttgcaatgtcaacggcgcgggtatctgaccaaccgatttgtcttgttccgatcctcagtttcggcgagaacgacgtgtacgaccaagtccgcggggaccgatcgtcgaagttgtataagatccagacttttatcaagaaagcggccgggtttacgctaccattgatgtatgcgcgcggtatatttaattacgactttgggctgatgccgtaccgcaggcaaatgacgctcgtggtcggcaagccgattgcagtgccgtacgtggcccagcctacggaggctgaaatcgaagtgtatcacaagcagtacatggatgaattgaggaggttatgggacacgtataaggacgactattttgtagaccacaagggcaagggggtcaagaattccgagatgcgttttgtggagtaa

SEQ ID NO: 272 - protein, 410 aa, Lipomyces starkeyi
MSEKAEIEVPPQKSTFPRSVHFAPLHIPLERRLQTLAVLFHTVALPYCIGLFFLMLAFPPFWPLLVMYVIYAYGFDHSSSNGEISRRRSPLFRRLPLFRLYCDYFPIHIHREVPLEPTFPGRLREPSGLVERWIAKMFGVQDAVVEGNESDVKATANGNGTTKEIGPTYVFGYHPHGIVSLGAFGAIGTEGAGWEKLFPGIPVSLLTLETNFSLPFYREYLLSLGIASVSRRSCTNLLKHDQSICIVIGGAQESLLAEPGTLDLILVKRRGFVKLAMSTARVSDQPICLVPILSFGENDVYDQVRGDRSSKLYKIQTFIKKAAGFTLPLMYARGIFNYDFGLMPYRRQMTLVVGKPIAVPYVAQPTEAEIEVYHKQYMDELRRLWDTYKDDYFVDHKGKGVKNSEMRFVE

SEQ ID NO: 273 - DNA, 8329 bp, Artificial Sequence
  plasmid pKR1337
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgagtgagaaggcagagatcgaggttccgccgcaaaaatcgacattccctcgcagtgtgcacttcgctccacttcatattccactggagagacgcctacagactttggcagtcttattccacactgtcgcgctaccatactgcatcggtctgttctttctcatgctcgcgttccctcctttttggccattattggtaatgtatgtcatatacgcatacgggttcgaccactcgagctcgaacggagagatctcccgccggcgatcgccgctgtttcgaagactcccgttgttcaggctgtattgtgattacttccccatccacattcaccgggaggttccgctcgagccgacgtttcctggtcgccttcgcgaaccgagtggccttgtcgagcggtggattgcgaagatgttcggcgtgcaggacgctgttgtcgagggaaatgaatctgacgttaaggccacggccaacggcaatgggacgacgaaagaaatcggaccgacgtatgttttcggctatcatccgcatggaattgttagcttgggtgcgtttggtgctattggtacggaaggcgctggatgggagaagctctttcctgggatcccggtgtcactgctgactctcgaaacaaatttcagccttccattttacagagagtatttgctgtcacttgggattgcttcagtatctcgacggtcttgtaccaatctcctcaaacacgaccaatccatctgcatcgttatcggcggcgcccaagagtcgctcttagcggaaccaggcactctagatctgatcctcgttaaacgtcgcggttttgtcaaacttgcaatgtcaacggcgcgggtatctgaccaaccgatttgtcttgttccgatcctcagtttcggcgagaacgacgtgtacgaccaagtccgcggggaccgatcgtcgaagttgtataagatccagacttttatcaagaaagcggccgggtttacgctaccattgatgtatgcgcgcggtatatttaattacgactttgggctgatgccgtaccgcaggcaaatgacgctcgtggtcggcaagccgattgcagtgccgtacgtggcccagcctacggaggctgaaatcgaagtgtatcacaagcagtacatggatgaattgaggaggttatgggacacgtataaggacgactattttgtagaccacaagggcaagggggtcaagaattccgagatgcgttttgtggagtaagc

SEQ ID NO: 274 - DNA, 8666 bp, Artificial Sequence
  plasmid pMDGAT1-17 comprising M. alpina DGAT1
  misc_feature (467)..(467): n is a, c, g, or t
catggcagagtcgacaacaacgacatgtgcaaaggaggagggcattgccaacagcgctgctttgcctgacattcccccaaagatggaagacctcaagtcctccaggaagaccggctcttcttacaagcacaccttccccgtccatacaaaaaccatccccagcccattgtctaaagaggcacctccagagagctatcgtggattcgtcaacctcggcatgctcctacttttcggcaacaacatccgattgatcatcgagaattacctcaaatacggcttcctgctctcaatccctggatcaagcgtctcgaagcaggactggatcctggctgccctcacccacgccatcctacccgtcaacctcatcctggcctacaagcttgagagctgggccaaggagagagccgtcggctatcgcaagcgtcgatctgacgaacccattgcccaggaatcaaccaaggccgtgncagcaggagataatgacgctatcaaaaccacaaaacccgccaaggcccaggatctcacacccgaggcccttgcaaggaaggaacaatcgaccgtgggctggctccatgtcttcaatctgttcaccatcgttgcctggccctccttcatgtcctactttatgatctaccaccccttcgtggccatgtcctgcctcatgaacggacttatcctcttcctcaaaatgacctcctttgcgcttgtgaaccaggagctccgagcagcctacatctttggaacacccgtggacacgttccagcacatggctaaagtgcacgacatctctggcaaggacctgacaaagaaggagatcttccagtatgacatccagtaccccgacaacatcaccctcaagaacattggctatttctggctcgcccccacgctctgctaccagccatcatacccaaggacgaccgtcttccgcaaatccttcttcctcaagcgtgtggccgagatcgtgacctgtctgggcatgatgtactttttagtcgagcagtacgccacccccaccctgcagaactcggtccgagcattcgatgagttggcgttcggcaccattctggagagagtgctgaagctgagcaccaccagtgtcatcatctggctactcatgttctacacctttttccactcgttctttaatgctcttgcagaggcactgtactttggagaccgtcgcttctatctcgcctggtggaatgccactggtgtcggcatgtactggaagacgtggaactcgcccgtctacaccttcttcaaacgccacgtatacctgcccctgatcacctctggcacctctcccatggtcgcctcgatcgtcatcttcctcatctcggctgtcttgcacgagatcttgatcggcttccccactcatatgatctatggatacgcattcgccggcatgttcctccagatcccgctgatcattctgacccgacccctcgaaaaatggcgaggcaccggatcgggtctcggcaacatgatcttctgggtctcgttcaccatcctgggccagccagcgtgtgcgctgctctactactaccactggaccaagcgccatatggatgtttgagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgactcaggcgacgacggaattcctgcagcccatctgcagaattcaggagagaccgggttggcggcgtatttgtgtcccaaaaaacagccccaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctc

SEQ ID NO: 275 - DNA, 33 bp, Artificial Sequence
  primer for Morteriella alpina DGAT1
tgcggccgcaccatgacagagtcgacaacaacg

SEQ ID NO: 276 - DNA, 28 bp, Artificial Sequence
  primer for Morteriella alpina DGAT1
agcggccgctcaaacatccatatggcgc

SEQ ID NO: 277 - DNA, 5111 bp, Morteriella alpina
aattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacgcgttagaatactcaagctatgcatcaagcttggtaccgagctcggatccactagtaacggccgccagtgtgctggaattcagggcggccgcaccatgacagagtcgacaacaacgacatgtacaaaggaggagggcattgccaacagcgctgctttgcctgacattcccccaaagatggaagacctcaagtcctccaggaagaccggctcttcttacaagcacaccttccccgtccatacaaaaaccatccccagcccattgtctaaagaggcacctccagagagctatcgtggattcgtcaacctcggcatgctcctacttttcggcaacaacatccgattgatcatcgagaattacctcaaatacggcttcctgctctcaatccctggatcaagcgtctcgaagcaggactggatcctggctgccctcacccacgccatcctacccgtcaacctcatcctggcctacaagcttgagagctgggccaaggagagagccgtcggctatcgcaagcgtcgatctgacgaacccattgcccaggaatcaaccaaggccgttgcagcaggagataatgacgctatcaaaaccacaaaacccgccaaggcccaggatctcacacccgaggcccttgcaaggaaggaacaatcgaccgtgggctggctccatgtcttcaatctgttcaccatcgttgcctggccctccttcatgtcctactttatgatctaccaccccttcgtggccatgtcctgcctcatgaacggacttatcctcttcctcaaaatgacctcctttgcgcttgtgaaccaggagctccgagcagcctacatctttggaacacccgtggacacgttccagcacatggctaaagtgcacgacatctctggcaaggacctgacaaagaaggagatcttccagtatgacatccagtaccccgacaacatcaccctcaagaacattggctatttctggctcgcccccacgctctgctaccagccatcatacccaaggacgaccgtcttccgcaaatccttcttcctcaagcgtgtggccgagatcgtgacctgtctgggcatgatgtactttttagtcgagcagtacgccacccccaccctgcagaactcggtccgagcattcgatgagttggcgttcggcaccattctggagagagtgctgaagctgagcaccaccagtgtcatcatctggctactcatgttctacacctttttccactcgttctttaatgctcttgcagaggcactgtactttggagaccgtcgcttctatctcgcctggtggaatgccactggtgtcggcatgtactggaagacgtggaactcgcccgtctacaccttcttcaaacgccacgtatacctgcccctgatcacctctggcacctctcccatggtcgcctcgatcgtcatcttcttcatctcggctgtcttgcacgagatcttgatcggcttccccactcatatgatctatggatacgcattcgccggcatgttcctccagatcccgctgatcattctgacccgacccctcgaaaaatggcgaggcaccggatcgggtctcggcaacatgatcttctgggtctcgttcaccatcctgggccagccagcgtgtgcgctgctctactactaccactggaccaagcgccatatggatgtttgagcggccgctcctg

SEQ ID NO: 278 - DNA, 1578 bp, Mortierella alpina
atgacagagtcgacaacaacgacatgtacaaaggaggagggcattgccaacagcgctgctttgcctgacattcccccaaagatggaagacctcaagtcctccaggaagaccggctcttcttacaagcacaccttccccgtccatacaaaaaccatccccagcccattgtctaaagaggcacctccagagagctatcgtggattcgtcaacctcggcatgctcctacttttcggcaacaacatccgattgatcatcgagaattacctcaaatacggcttcctgctctcaatccctggatcaagcgtctcgaagcaggactggatcctggctgccctcacccacgccatcctacccgtcaacctcatcctggcctacaagcttgagagctgggccaaggagagagccgtcggctatcgcaagcgtcgatctgacgaacccattgcccaggaatcaaccaaggccgttgcagcaggagataatgacgctatcaaaaccacaaaacccgccaaggcccaggatctcacacccgaggcccttgcaaggaaggaacaatcgaccgtgggctggctccatgtcttcaatctgttcaccatcgttgcctggccctccttcatgtcctactttatgatctaccaccccttcgtggccatgtcctgcctcatgaacggacttatcctcttcctcaaaatgacctcctttgcgcttgtgaaccaggagctccgagcagcctacatctttggaacacccgtggacacgttccagcacatggctaaagtgcacgacatctctggcaaggacctgacaaagaaggagatcttccagtatgacatccagtaccccgacaacatcaccctcaagaacattggctatttctggctcgcccccacgctctgctaccagccatcatacccaaggacgaccgtcttccgcaaatccttcttcctcaagcgtgtggccgagatcgtgacctgtctgggcatgatgtactttttagtcgagcagtacgccacccccaccctgcagaactcggtccgagcattcgatgagttggcgttcggcaccattctggagagagtgctgaagctgagcaccaccagtgtcatcatctggctactcatgttctacacctttttccactcgttctttaatgctcttgcagaggcactgtactttggagaccgtcgcttctatctcgcctggtggaatgccactggtgtcggcatgtactggaagacgtggaactcgcccgtctacaccttcttcaaacgccacgtatacctgcccctgatcacctctggcacctctcccatggtcgcctcgatcgtcatcttcttcatctcggctgtcttgcacgagatcttgatcggcttccccactcatatgatctatggatacgcattcgccggcatgttcctccagatcccgctgatcattctgacccgacccctcgaaaaatggcgaggcaccggatcgggtctcggcaacatgatcttctgggtctcgttcaccatcctgggccagccagcgtgtgcgctgctctactactaccactggaccaagcgccatatggatgtttga

SEQ ID NO: 279 - protein, 525 aa, Mortierella alpina
MTESTTTTCTKEEGIANSAALPDIPPKMEDLKSSRKTGSSYKHTFPVHTKTIPSPLSKEAPPESYRGFVNLGMLLLFGNNIRLIIENYLKYGFLLSIPGSSVSKQDWILAALTHAILPVNLILAYKLESWAKERAVGYRKRRSDEPIAQESTKAVAAGDNDAIKTTKPAKAQDLTPEALARKEQSTVGWLHVFNLFTIVAWPSFMSYFMIYHPFVAMSCLMNGLILFLKMTSFALVNQELRAAYIFGTPVDTFQHMAKVHDISGKDLTKKEIFQYDIQYPDNITLKNIGYFWLAPTLCYQPSYPRTTVFRKSFFLKRVAEIVTCLGMMYFLVEQYATPTLQNSVRAFDELAFGTILERVLKLSTTSVIIWLLMFYTFFHSFFNALAEALYFGDRRFYLAWWNATGVGMYWKTWNSPVYTFFKRHVYLPLITSGTSPMVASIVIFFISAVLHEILIGFPTHMIYGYAFAGMFLQIPLIILTRPLEKWRGTGSGLGNMIFWVSFTILGQPACALLYYYHWTKRHMDV

SEQ ID NO: 280 - DNA, 8674 bp, Artificial Sequence
  plasmid pKR1334
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgacagagtcgacaacaacgacatgtacaaaggaggagggcattgccaacagcgctgctttgcctgacattcccccaaagatggaagacctcaagtcctccaggaagaccggctcttcttacaagcacaccttccccgtccatacaaaaaccatccccagcccattgtctaaagaggcacctccagagagctatcgtggattcgtcaacctcggcatgctcctacttttcggcaacaacatccgattgatcatcgagaattacctcaaatacggcttcctgctctcaatccctggatcaagcgtctcgaagcaggactggatcctggctgccctcacccacgccatcctacccgtcaacctcatcctggcctacaagcttgagagctgggccaaggagagagccgtcggctatcgcaagcgtcgatctgacgaacccattgcccaggaatcaaccaaggccgttgcagcaggagataatgacgctatcaaaaccacaaaacccgccaaggcccaggatctcacacccgaggcccttgcaaggaaggaacaatcgaccgtgggctggctccatgtcttcaatctgttcaccatcgttgcctggccctccttcatgtcctactttatgatctaccaccccttcgtggccatgtcctgcctcatgaacggacttatcctcttcctcaaaatgacctcctttgcgcttgtgaaccaggagctccgagcagcctacatctttggaacacccgtggacacgttccagcacatggctaaagtgcacgacatctctggcaaggacctgacaaagaaggagatcttccagtatgacatccagtaccccgacaacatcaccctcaagaacattggctatttctggctcgcccccacgctctgctaccagccatcatacccaaggacgaccgtcttccgcaaatccttcttcctcaagcgtgtggccgagatcgtgacctgtctgggcatgatgtactttttagtcgagcagtacgccacccccaccctgcagaactcggtccgagcattcgatgagttggcgttcggcaccattctggagagagtgctgaagctgagcaccaccagtgtcatcatctggctactcatgttctacacctttttccactcgttctttaatgctcttgcagaggcactgtactttggagaccgtcgcttctatctcgcctggtggaatgccactggtgtcggcatgtactggaagacgtggaactcgcccgtctacaccttcttcaaacgccacgtatacctgcccctgatcacctctggcacctctcccatggtcgcctcgatcgtcatcttcttcatctcggctgtcttgcacgagatcttgatcggcttccccactcatatgatctatggatacgcattcgccggcatgttcctccagatcccgctgatcattctgacccgacccctcgaaaaatggcgaggcaccggatcgggtctcggcaacatgatcttctgggtctcgttcaccatcctgggccagccagcgtgtgcgctgctctactactaccactggaccaagcgccatatggatgtttgagc

SEQ ID NO: 281 - DNA, 4547 bp, Artificial Sequence
  plasmid pKR1314
ggccgctctagaactagtggatcccccgggctgcaggaattcgatatcaagcttatcgataccgtcgacctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgcatggaggtgcgcagacgcaagattgacgttctcaaggcccagaagaatggttacgagtccggcccaccatctagacagtcctctcagccatcctctagagcctcctccagaacacgcaacaagcactcctcctccacactttccctttccggcctcaccatgaaggtgcagaagaagccagctggtccaccagccaactccaagaccccattcctccacatcaagccagtgcacacttgctgctccacctcaatgctctccagagactacgacggctccaacccatccttcaagggcttcaagaacatcggcatgatcatcctcatcgtgggcaatcttcgcctcgccttcgagaactacctcaagtacggcatctccaaccccttcttcgaccccaagatcacaccctccgagtggcagctttctggacttctcatcgttgtggcttacgctcacatcctcatggcttacgctatcgagtccgctgccaagctcctcttcctctcctccaagcaccactacatggccgttggtctcctccacaccatgaacaccctctcctccatttccctcctctcctacgtggtgtactactacctccccaatccagtggctggcactatcgttgagttcgtggccgtgatcctttctctcaagctcgcttcctacgcccttaccaactccgatctcagaaaggctgccattcacgcccagaagctcgacaagacacaggacgacaacgagaaggagtccacctcctcttcctcttcctctgacgacgccgagacacttgccgacatcgacgttatcccagcttactacgctcagcttccctacccacagaacgttaccctctccaacctcctctacttctggttcgctcccacccttgtgtaccagcccgtttacccaaagacagagagaatccgccccaagcatgtgatccgcaacctcttcgagcttgtgtctctctgcatgctcatccagttcctcatcttccagtacgcctaccccatcatgcagtcttgccttgccctcttcttccagccaaagctcgactacgccaacatttccgagcgcctcatgaagctcgcctctgtgtccatgatggtgtggctcatcggtttctacgccttcttccagaacggtctcaacctcatcgccgagctcacctgcttcggtaaccgcacattctaccagcagtggtggaactccagatctattggccagtactggacactctggaacaagcccgtgaaccagtacttccgccatcacgtttacgttcctcttctcgctaggggcatgtccagattcaacgcctctgttgtggtgttcttcttctccgctgtgattcacgagctccttgtgggcattcccacacacaacatcatcggcgctgccttcttcggaatgatgtcccaggtgccacttatcatggccaccgagaaccttcagcacatcaactcctcccttggcccattccttggtaactgcgctttctggttcaccttcttccttggtcagcctacctgcgcctttctctactaccttgcctacaactacaagcagaaccagtaggc

SEQ ID NO: 282 - DNA, 22 bp, Artificial Sequence
  primer for Yarrowia lipolytica DGAT1
gcggccgcaccatggaggtgcg

SEQ ID NO: 283 - DNA, 19 bp, Artificial Sequence
  primer for Yarrowia lipolytica DGAT1
gaggtttgagagggtaacg

SEQ ID NO: 284 - DNA, 22 bp, Artificial Sequence
  primer for Yarrowia lipolytica DGAT1
tctcaaacctcctctacttctg

SEQ ID NO: 285 - DNA, 20 bp, Artificial Sequence
  primer for Yarrowia lipolytica DGAT1
caatagatcttgagttccac

SEQ ID NO: 286 - DNA, 4749 bp, Artificial Sequence
  plasmid pKR1310
aattctgcagatatccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacgcgttagaatactcaagctatgcatcaagcttggtaccgagctcggatccactagtaacggccgccagtgtgctggaattcagggcggccgcaccatggaggtgcgcagacgcaagattgacgttctcaaggcccagaagaatggttacgagtccggcccaccatctagacagtcctctcagccatcctctagagcctcctccagaacacgcaacaagcactcctcctccacactttccctttccggcctcaccatgaaggtgcagaagaagccagctggtccaccagccaactccaagaccccattcctccacatcaagccagtgcacacttgctgctccacctcaatgctctccagagactacgacggctccaacccatccttcaagggcttcaagaacatcggcatgatcatcctcatcgtgggcaatcttcgcctcgccttcgagaactacctcaagtacggcatctccaaccccttcttcgaccccaagatcacaccctccgagtggcagctttctggacttctcatcgttgtggcttacgctcacatcctcatggcttacgctatcgagtccgctgccaagctcctcttcctctcctccaagcaccactacatggccgttggtctcctccacaccatgaacaccctctcctccatttccctcctctcctacgtggtgtactactacctccccaatccagtggctggcactatcgttgagttcgtggccgtgatcctttctctcaagctcgcttcctacgcccttaccaactccgatctcagaaaggctgccattcacgcccagaagctcgacaagacacaggacgacaacgagaaggagtccacctcctcttcctcttcctctgacgacgccgagacacttgccgacatcgacgttatcccagcttactacgctcagcttccctacccacagaacgttaccctctcaaacctcctctacttctggttcgctcccacccttgtgtaccagcccgtttacccaaagacagagagaatccgccccaagcatgtgatccgcaacctcttcgagcttgtgtctctctgcatgctcatccagttcctcatcttccagtacgcctaccccatcatgcagtcttgccttgccctcttcttccagccaaagctcgactacgccaacatttccgagcgcctcatgaagctcgcctctgtgtccatgatggtgtggctcatcggtttctacgccttcttccagaacggtctcaacctcatcgccgagctcacctgcttcggtaaccgcacattctaccagcagtggtggaactcaagatctattgcctg

SEQ ID NO: 287 - DNA, 5136 bp, Artificial Sequence
  plasmid pKR1316
atccatcacactggcggccgctcgagcatgcatctagagggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctatacgtacggcagtttaaggtttacacctataaaagagagagccgttatcgtctgtttgtggatgtacagagtgatattattgacacgccggggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggcatgagattatcaaaaaggatcttcacctagatccttttcacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttctcgccgccaaggatctgatggcgcaggggatcaagctctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgagcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaattattaacgcttacaatttcctgatgcggtattttctccttacgcatctgtgcggtatttcacaccgcatacaggtggcacttttcggggaaatgtgcgcggaacccctatttgtttatttttctaaatacattcaaatatgtatccgctcatgagacaataaccctgataaatgcttcaataatagcacgtgaggagggccaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtgctaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctgggcttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctatttaggtgacgcgttagaatactcaagctatgcatcaagcttggtaccgagctcggatccactagtaacggccgccagtgtgctggaattcagggcggccgcaccatggaggtgcgcagacgcaagattgacgttctcaaggcccagaagaatggttacgagtccggcccaccatctagacagtcctctcagccatcctctagagcctcctccagaacacgcaacaagcactcctcctccacactttccctttccggcctcaccatgaaggtgcagaagaagccagctggtccaccagccaactccaagaccccattcctccacatcaagccagtgcacacttgctgctccacctcaatgctctccagagactacgacggctccaacccatccttcaagggcttcaagaacatcggcatgatcatcctcatcgtgggcaatcttcgcctcgccttcgagaactacctcaagtacggcatctccaaccccttcttcgaccccaagatcacaccctccgagtggcagctttctggacttctcatcgttgtggcttacgctcacatcctcatggcttacgctatcgagtccgctgccaagctcctcttcctctcctccaagcaccactacatggccgttggtctcctccacaccatgaacaccctctcctccatttccctcctctcctacgtggtgtactactacctccccaatccagtggctggcactatcgttgagttcgtggccgtgatcctttctctcaagctcgcttcctacgcccttaccaactccgatctcagaaaggctgccattcacgcccagaagctcgacaagacacaggacgacaacgagaaggagtccacctcctcttcctcttcctctgacgacgccgagacacttgccgacatcgacgttatcccagcttactacgctcagcttccctacccacagaacgttaccctctcaaacctcctctacttctggttcgctcccacccttgtgtaccagcccgtttacccaaagacagagagaatccgccccaagcatgtgatccgcaacctcttcgagcttgtgtctctctgcatgctcatccagttcctcatcttccagtacgcctaccccatcatgcagtcttgccttgccctcttcttccagccaaagctcgactacgccaacatttccgagcgcctcatgaagctcgcctctgtgtccatgatggtgtggctcatcggtttctacgccttcttccagaacggtctcaacctcatcgccgagctcacctgcttcggtaaccgcacattctaccagcagtggtggaactcaagatctattggccagtactggacactctggaacaagcccgtgaaccagtacttccgccatcacgtttacgttcctcttctcgctaggggcatgtccagattcaacgcctctgttgtggtgttcttcttctccgctgtgattcacgagctccttgtgggcattcccacacacaacatcatcggcgctgccttcttcggaatgatgtcccaggtgccacttatcatggccaccgagaaccttcagcacatcaactcctcccttggcccattccttggtaactgcgctttctggttcaccttcttccttggtcagcctacctgcgcctttctctactaccttgcctacaactacaagcagaaccagtaggcggccgctctagaactagtggatcccccgggctgcaggaattcgat

SEQ ID NO: 288 - DNA, 1581 bp, Yarrowia lipolytica
atggaggtgcgcagacgcaagattgacgttctcaaggcccagaagaatggttacgagtccggcccaccatctagacagtcctctcagccatcctctagagcctcctccagaacacgcaacaagcactcctcctccacactttccctttccggcctcaccatgaaggtgcagaagaagccagctggtccaccagccaactccaagaccccattcctccacatcaagccagtgcacacttgctgctccacctcaatgctctccagagactacgacggctccaacccatccttcaagggcttcaagaacatcggcatgatcatcctcatcgtgggcaatcttcgcctcgccttcgagaactacctcaagtacggcatctccaaccccttcttcgaccccaagatcacaccctccgagtggcagctttctggacttctcatcgttgtggcttacgctcacatcctcatggcttacgctatcgagtccgctgccaagctcctcttcctctcctccaagcaccactacatggccgttggtctcctccacaccatgaacaccctctcctccatttccctcctctcctacgtggtgtactactacctccccaatccagtggctggcactatcgttgagttcgtggccgtgatcctttctctcaagctcgcttcctacgcccttaccaactccgatctcagaaaggctgccattcacgcccagaagctcgacaagacacaggacgacaacgagaaggagtccacctcctcttcctcttcctctgacgacgccgagacacttgccgacatcgacgttatcccagcttactacgctcagcttccctacccacagaacgttaccctctcaaacctcctctacttctggttcgctcccacccttgtgtaccagcccgtttacccaaagacagagagaatccgccccaagcatgtgatccgcaacctcttcgagcttgtgtctctctgcatgctcatccagttcctcatcttccagtacgcctaccccatcatgcagtcttgccttgccctcttcttccagccaaagctcgactacgccaacatttccgagcgcctcatgaagctcgcctctgtgtccatgatggtgtggctcatcggtttctacgccttcttccagaacggtctcaacctcatcgccgagctcacctgcttcggtaaccgcacattctaccagcagtggtggaactcaagatctattggccagtactggacactctggaacaagcccgtgaaccagtacttccgccatcacgtttacgttcctcttctcgctaggggcatgtccagattcaacgcctctgttgtggtgttcttcttctccgctgtgattcacgagctccttgtgggcattcccacacacaacatcatcggcgctgccttcttcggaatgatgtcccaggtgccacttatcatggccaccgagaaccttcagcacatcaactcctcccttggcccattccttggtaactgcgctttctggttcaccttcttccttggtcagcctacctgcgcctttctctactaccttgcctacaactacaagcagaaccagtag

SEQ ID NO: 289 - DNA, 8677 bp, Artificial Sequence
  plasmid pKR1323
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaggtgcgcagacgcaagattgacgttctcaaggcccagaagaatggttacgagtccggcccaccatctagacagtcctctcagccatcctctagagcctcctccagaacacgcaacaagcactcctcctccacactttccctttccggcctcaccatgaaggtgcagaagaagccagctggtccaccagccaactccaagaccccattcctccacatcaagccagtgcacacttgctgctccacctcaatgctctccagagactacgacggctccaacccatccttcaagggcttcaagaacatcggcatgatcatcctcatcgtgggcaatcttcgcctcgccttcgagaactacctcaagtacggcatctccaaccccttcttcgaccccaagatcacaccctccgagtggcagctttctggacttctcatcgttgtggcttacgctcacatcctcatggcttacgctatcgagtccgctgccaagctcctcttcctctcctccaagcaccactacatggccgttggtctcctccacaccatgaacaccctctcctccatttccctcctctcctacgtggtgtactactacctccccaatccagtggctggcactatcgttgagttcgtggccgtgatcctttctctcaagctcgcttcctacgcccttaccaactccgatctcagaaaggctgccattcacgcccagaagctcgacaagacacaggacgacaacgagaaggagtccacctcctcttcctcttcctctgacgacgccgagacacttgccgacatcgacgttatcccagcttactacgctcagcttccctacccacagaacgttaccctctcaaacctcctctacttctggttcgctcccacccttgtgtaccagcccgtttacccaaagacagagagaatccgccccaagcatgtgatccgcaacctcttcgagcttgtgtctctctgcatgctcatccagttcctcatcttccagtacgcctaccccatcatgcagtcttgccttgccctcttcttccagccaaagctcgactacgccaacatttccgagcgcctcatgaagctcgcctctgtgtccatgatggtgtggctcatcggtttctacgccttcttccagaacggtctcaacctcatcgccgagctcacctgcttcggtaaccgcacattctaccagcagtggtggaactcaagatctattggccagtactggacactctggaacaagcccgtgaaccagtacttccgccatcacgtttacgttcctcttctcgctaggggcatgtccagattcaacgcctctgttgtggtgttcttcttctccgctgtgattcacgagctccttgtgggcattcccacacacaacatcatcggcgctgccttcttcggaatgatgtcccaggtgccacttatcatggccaccgagaaccttcagcacatcaactcctcccttggcccattccttggtaactgcgctttctggttcaccttcttccttggtcagcctacctgcgcctttctctactaccttgcctacaactacaagcagaaccagtaggc

SEQ ID NO: 290 - DNA, 32 bp, Artificial Sequence
  primer for Phaffia rhodozyma DGAT2
agcggccgcaccatggatccacagacagatcc

SEQ ID NO: 291 - DNA, 30 bp, Artificial Sequence
  primer for Phaffia rhodozyma DGAT2
agcggccgctcagtccacaagcgtcaactc

SEQ ID NO: 292 - DNA, 4751 bp, Artificial Sequence
  plasmid pHD37
cctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaccatggatccacagacagatccttcatctccgacccagtcgcctgtacttccaaaggaaggactcagtcttcgtccgacaaggtcaaaatcatccttggtcgagttcggatcgtcatccatcagtggactcagggacaatatctcgacagggatcaacacactctccactggtctcaagacccaagttgagaagagacggaaagatctcccaaaaggaatcgaaataaagtttgcgcccctcaaagtcccaagaaaccgccgtttacaaacaggcgccgtggctctctggtcaacccttcttccgatatgcacttctatctttctctggatgtgctctatcccgagactgtggcctctcttgattccttatcttatctgggtgttctacatcgaccgcgcgcccgtactcggcggcagacccaaacgatggctcagaaggatgggcatctggaaacactttgccaattattatcctgtctctctagtacaagaggcttccctgcctttagacaggaagtacatctttggatatcacccgcacggtgtcatcgggatgggagctttcgccaactttgctacagaaggcactaacttctcgaagatatttcctgggattgaaccccaccttttaacactcgctcctaattttaagataccactgtatcgggacttgcttcttcttctaggaatgtgctctgtttcaaaacgatcatgttcctccatccttcgtaaaggaccccctggtacagccatcgtgatcgttgttggaggcgctactgaatcgcttcgggcccacccgggaacagccgacttgacactcaagagtagaatgggtttcatcaaaattgccataaatgagggcgttgacttggtaccggtgttttcgtttggcgaaaacgatatctatgatcagctagcgaatgagagagggacacagatctacaaactacagaaaagattccaaagcatctttgggtttactttgcccttgttccacggaagagggttattcaattattcggttggtctgatgccatataggcaacccattgtttctgtagccggaaggccgatccgagttgtccagtgtaacaacccgacatcggagcagttgcaggagacacaaggacggtacatcgaggagcttttacggatctgggatacatataaggacgtgtatgctaggaacagaacaaaagagttgacgcttgtggactgagcggccgct

SEQ ID NO: 293 - DNA, 1218 bp, Phaffia rhodozyma
atggatccacagacagatccttcatctccgacccagtcgcctgtacttccaaaggaaggactcagtcttcgtccgacaaggtcaaaatcatccttggtcgagttcggatcgtcatccatcagtggactcagggacaatatctcgacagggatcaacacactctccactggtctcaagacccaagttgagaagagacggaaagatctcccaaaaggaatcgaaataaagtttgcgcccctcaaagtcccaagaaaccgccgtttacaaacaggcgccgtggctctctggtcaacccttcttccgatatgcacttctatctttctctggatgtgctctatcccgagactgtggcctctcttgattccttatcttatctgggtgttctacatcgaccgcgcgcccgtactcggcggcagacccaaacgatggctcagaaggatgggcatctggaaacactttgccaattattatcctgtctctctagtacaagaggcttccctgcctttagacaggaagtacatctttggatatcacccgcacggtgtcatcgggatgggagctttcgccaactttgctacagaaggcactaacttctcgaagatatttcctgggattgaaccccaccttttaacactcgctcctaattttaagataccactgtatcgggacttgcttcttcttctaggaatgtgctctgtttcaaaacgatcatgttcctccatccttcgtaaaggaccccctggtacagccatcgtgatcgttgttggaggcgctactgaatcgcttcgggcccacccgggaacagccgacttgacactcaagagtagaatgggtttcatcaaaattgccataaatgagggcgttgacttggtaccggtgttttcgtttggcgaaaacgatatctatgatcagctagcgaatgagagagggacacagatctacaaactacagaaaagattccaaagcatctttgggtttactttgcccttgttccacggaagagggttattcaattattcggttggtctgatgccatataggcaacccattgtttctgtagccggaaggccgatccgagttgtccagtgtaacaacccgacatcggagcagttgcaggagacacaaggacggtacatcgaggagcttttacggatctgggatacatataaggacgtgtatgctaggaacagaacaaaagagttgacgcttgtggactga

SEQ ID NO: 294 - DNA, 8314 bp, Artificial Sequence
  plasmid pKR1372
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggatccacagacagatccttcatctccgacccagtcgcctgtacttccaaaggaaggactcagtcttcgtccgacaaggtcaaaatcatccttggtcgagttcggatcgtcatccatcagtggactcagggacaatatctcgacagggatcaacacactctccactggtctcaagacccaagttgagaagagacggaaagatctcccaaaaggaatcgaaataaagtttgcgcccctcaaagtcccaagaaaccgccgtttacaaacaggcgccgtggctctctggtcaacccttcttccgatatgcacttctatctttctctggatgtgctctatcccgagactgtggcctctcttgattccttatcttatctgggtgttctacatcgaccgcgcgcccgtactcggcggcagacccaaacgatggctcagaaggatgggcatctggaaacactttgccaattattatcctgtctctctagtacaagaggcttccctgcctttagacaggaagtacatctttggatatcacccgcacggtgtcatcgggatgggagctttcgccaactttgctacagaaggcactaacttctcgaagatatttcctgggattgaaccccaccttttaacactcgctcctaattttaagataccactgtatcgggacttgcttcttcttctaggaatgtgctctgtttcaaaacgatcatgttcctccatccttcgtaaaggaccccctggtacagccatcgtgatcgttgttggaggcgctactgaatcgcttcgggcccacccgggaacagccgacttgacactcaagagtagaatgggtttcatcaaaattgccataaatgagggcgttgacttggtaccggtgttttcgtttggcgaaaacgatatctatgatcagctagcgaatgagagagggacacagatctacaaactacagaaaagattccaaagcatctttgggtttactttgcccttgttccacggaagagggttattcaattattcggttggtctgatgccatataggcaacccattgtttctgtagccggaaggccgatccgagttgtccagtgtaacaacccgacatcggagcagttgcaggagacacaaggacggtacatcgaggagcttttacggatctgggatacatataaggacgtgtatgctaggaacagaacaaaagagttgacgcttgtggactgagc

SEQ ID NO: 295 - DNA, 33 bp, Artificial Sequence
  primer for Lipomyces starkeyii DGAT1
agcggccgcaccatgctagatcacatcagctcg

SEQ ID NO: 296 - DNA, 30 bp, Artificial Sequence
  primer for Lipomyces starkeyii DGAT1
agcggccgcctagctctcgaccatctttac

SEQ ID NO: 297 - DNA, 5198 bp, Artificial Sequence
  plasmid pHD38
cctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaccatgctagatcacatcagctcgggaacagcaactgcctcaacaacgacagtcatgtcgaccgctgcacaatctgatacagacaacgaggatatatcgactgtcgatttggttgactctcgtgcagatactcacacatcttcaaatgttatgttgcaacagcaaaaatcgcgtcggagactaatcgggaaagacgccgagccaagaacacagcatccgtctggaggcaaatcggagaaggaggagttgacgaagccggatgactcaaagggacccataaaattaagtcacatatacccgatacatgccgttagccgaggcagtattctgtcacgagagtcgacaactcctacaccgagttttgttgggtttcgaaacttagccatgatagtgctagccgtcagcaatcttcgattggtgattgaaaattactcaaagtacggcgttctgatccgattcgcccgactcggtatttcacaaaaggacattctgtattgcatattcttgaccgctaccatcccgctgcacctatttattgctattgtcattgaaagactagttgcgattccgacggtaaactacgtcgcttcgctcagcgagagcgaggataaaaaacgctccaaccccaaaatgggacggaaggggggcagtatatcgattttgcgtcctaagccaaaatatatgtggcgcctgatcgtcctattgcattcaataaacgcaatggcttgcttgtgggttacgactgttgttgtttacaattctatttatcatccccttattgggacagcttgtgaatttcatgcagtgattgtgtgtcttaaggtcgcatcgtttgcgcttaccaatcgcgatcttcgggagtcgatgctgaactctcaacctgtgccagccatatacaacttggccccttatccaaaaaacttaaccctcaagaacttgtcatacttttggtgggcgccgactcttgtttatcaacctgtctatccgcgatcgccttcattccggcctttgttttttgtcaagcggattctggagatggtgggcctatcatttttaatatggttcttgtcagctcaatatgctgtgccgacgctagaaaatagtttggtgcattttcacagtttgcaattcatgggaattatggagcgactcatgaagcttgctagcattagcatggctatttggcttgctggttttttctgcatttttcagtctggactcaatgcgcttgcggaggtaatgcggtttggtgacagagccttttacgacgactggtggaacagcaaatctgtgggagagtattggcgtctgtggaataagccggttacgaattacttccggcgtcatatttacgtaccgcttgtgcgccgcgggtggaattctgcgacagccagtgtcatggtatttttcgtcagcgcggtgttgcatgagctagttgttggagttccgacgcataacgtaattggagttgcattctcgtcgatgattctacaaatcccactcatacaagtaaccgcgcctctggagaagatgcatggacctacatctggaataatagggaactgtatcttttggtttagcttcttcatcggtcagcctctgggcgtgctactttactattttgcgtggaacgttagtatgagcaaagtaaagatggtcgagagctaggcggccgct

SEQ ID NO: 298 - DNA, 1665 bp, Lipomyces starkeyi
atgctagatcacatcagctcgggaacagcaactgcctcaacaacgacagtcatgtcgaccgctgcacaatctgatacagacaacgaggatatatcgactgtcgatttggttgactctcgtgcagatactcacacatcttcaaatgttatgttgcaacagcaaaaatcgcgtcggagactaatcgggaaagacgccgagccaagaacacagcatccgtctggaggcaaatcggagaaggaggagttgacgaagccggatgactcaaagggacccataaaattaagtcacatatacccgatacatgccgttagccgaggcagtattctgtcacgagagtcgacaactcctacaccgagttttgttgggtttcgaaacttagccatgatagtgctagccgtcagcaatcttcgattggtgattgaaaattactcaaagtacggcgttctgatccgattcgcccgactcggtatttcacaaaaggacattctgtattgcatattcttgaccgctaccatcccgctgcacctatttattgctattgtcattgaaagactagttgcgattccgacggtaaactacgtcgcttcgctcagcgagagcgaggataaaaaacgctccaaccccaaaatgggacggaaggggggcagtatatcgattttgcgtcctaagccaaaatatatgtggcgcctgatcgtcctattgcattcaataaacgcaatggcttgcttgtgggttacgactgttgttgtttacaattctatttatcatccccttattgggacagcttgtgaatttcatgcagtgattgtgtgtcttaaggtcgcatcgtttgcgcttaccaatcgcgatcttcgggagtcgatgctgaactctcaacctgtgccagccatatacaacttggccccttatccaaaaaacttaaccctcaagaacttgtcatacttttggtgggcgccgactcttgtttatcaacctgtctatccgcgatcgccttcattccggcctttgttttttgtcaagcggattctggagatggtgggcctatcatttttaatatggttcttgtcagctcaatatgctgtgccgacgctagaaaatagtttggtgcattttcacagtttgcaattcatgggaattatggagcgactcatgaagcttgctagcattagcatggctatttggcttgctggttttttctgcatttttcagtctggactcaatgcgcttgcggaggtaatgcggtttggtgacagagccttttacgacgactggtggaacagcaaatctgtgggagagtattggcgtctgtggaataagccggttacgaattacttccggcgtcatatttacgtaccgcttgtgcgccgcgggtggaattctgcgacagccagtgtcatggtatttttcgtcagcgcggtgttgcatgagctagttgttggagttccgacgcataacgtaattggagttgcattctcgtcgatgattctacaaatcccactcatacaagtaaccgcgcctctggagaagatgcatggacctacatctggaataatagggaactgtatcttttggtttagcttcttcatcggtcagcctctgggcgtgctactttactattttgcgtggaacgttagtatgagcaaagtaaagatggtcgagagctag

SEQ ID NO: 299 - protein, 554 aa, Lipomyces starkeyi
MLDHISSGTATASTTTVMSTAAQSDTDNEDISTVDLVDSRADTHTSSNVMLQQQKSRRRLIGKDAEPRTQHPSGGKSEKEELTKPDDSKGPIKLSHIYPIHAVSRGSILSRESTTPTPSFVGFRNLAMIVLAVSNLRLVIENYSKYGVLIRFARLGISQKDILYCIFLTATIPLHLFIAIVIERLVAIPTVNYVASLSESEDKKRSNPKMGRKGGSISILRPKPKYMWRLIVLLHSINAMACLWVTTVVVYNSIYHPLIGTACEFHAVIVCLKVASFALTNRDLRESMLNSQPVPAIYNLAPYPKNLTLKNLSYFWWAPTLVYQPVYPRSPSFRPLFFVKRILEMVGLSFLIWFLSAQYAVPTLENSLVHFHSLQFMGIMERLMKLASISMAIWLAGFFCIFQSGLNALAEVMRFGDRAFYDDWWNSKSVGEYWRLWNKPVTNYFRRHIYVPLVRRGWNSATASVMVFFVSAVLHELVVGVPTHNVIGVAFSSMILQIPLIQVTAPLEKMHGPTSGIIGNCIFWFSFFIGQPLGVLLYYFAWNVSMSKVKMVES

SEQ ID NO: 300 - DNA, 8761 bp, Artificial Sequence
  plasmid pKR1375
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgctagatcacatcagctcgggaacagcaactgcctcaacaacgacagtcatgtcgaccgctgcacaatctgatacagacaacgaggatatatcgactgtcgatttggttgactctcgtgcagatactcacacatcttcaaatgttatgttgcaacagcaaaaatcgcgtcggagactaatcgggaaagacgccgagccaagaacacagcatccgtctggaggcaaatcggagaaggaggagttgacgaagccggatgactcaaagggacccataaaattaagtcacatatacccgatacatgccgttagccgaggcagtattctgtcacgagagtcgacaactcctacaccgagttttgttgggtttcgaaacttagccatgatagtgctagccgtcagcaatcttcgattggtgattgaaaattactcaaagtacggcgttctgatccgattcgcccgactcggtatttcacaaaaggacattctgtattgcatattcttgaccgctaccatcccgctgcacctatttattgctattgtcattgaaagactagttgcgattccgacggtaaactacgtcgcttcgctcagcgagagcgaggataaaaaacgctccaaccccaaaatgggacggaaggggggcagtatatcgattttgcgtcctaagccaaaatatatgtggcgcctgatcgtcctattgcattcaataaacgcaatggcttgcttgtgggttacgactgttgttgtttacaattctatttatcatccccttattgggacagcttgtgaatttcatgcagtgattgtgtgtcttaaggtcgcatcgtttgcgcttaccaatcgcgatcttcgggagtcgatgctgaactctcaacctgtgccagccatatacaacttggccccttatccaaaaaacttaaccctcaagaacttgtcatacttttggtgggcgccgactcttgtttatcaacctgtctatccgcgatcgccttcattccggcctttgttttttgtcaagcggattctggagatggtgggcctatcatttttaatatggttcttgtcagctcaatatgctgtgccgacgctagaaaatagtttggtgcattttcacagtttgcaattcatgggaattatggagcgactcatgaagcttgctagcattagcatggctatttggcttgctggttttttctgcatttttcagtctggactcaatgcgcttgcggaggtaatgcggtttggtgacagagccttttacgacgactggtggaacagcaaatctgtgggagagtattggcgtctgtggaataagccggttacgaattacttccggcgtcatatttacgtaccgcttgtgcgccgcgggtggaattctgcgacagccagtgtcatggtatttttcgtcagcgcggtgttgcatgagctagttgttggagttccgacgcataacgtaattggagttgcattctcgtcgatgattctacaaatcccactcatacaagtaaccgcgcctctggagaagatgcatggacctacatctggaataatagggaactgtatcttttggtttagcttcttcatcggtcagcctctgggcgtgctactttactattttgcgtggaacgttagtatgagcaaagtaaagatggtcgagagctaggc

SEQ ID NO: 301 - DNA, 1578 bp, Mortierella alpina
atgaccgagtccaccaccacaacctgcaccaaggaggagggcattgccaactctgccgctcttcccgacatcccaccaaagatggaggacctcaagtcctccagaaagaccggctcctcttacaagcacaccttccctgtgcacaccaagaccattccctcaccactttccaaggaggctccaccagagtcttaccgcggtttcgtgaacctcggcatgcttctcctcttcggcaacaacatccgcctcatcatcgagaactacctcaagtacggtttcctcctctccattcccggttcctccgtgtccaagcaggactggattctcgccgcccttacccatgccatccttcccgtgaacctcatcctcgcctacaagctcgagtcatgggctaaggagcgcgccgtgggttacagaaagcgcagatccgatgagccaatcgctcaggagtccaccaaggctgttgctgccggtgacaacgacgccatcaagaccaccaagccagctaaggctcaggaccttacaccagaggcccttgccagaaaggagcagtctaccgttggctggctccacgtgttcaacctcttcaccatcgtggcctggccctccttcatgtcctacttcatgatctaccatcccttcgtggccatgtcctgccttatgaacggcctcatcctcttcctcaagatgacctcattcgccctcgtgaaccaggagcttcgcgccgcttacatcttcggtacaccagtggacaccttccagcatatggccaaggtgcacgacatctccggcaaggacctcaccaagaaggagatcttccagtacgacatccagtaccctgacaacatcaccctcaagaacatcggctacttctggcttgctcccaccctctgctaccagccatcctacccacgcacaaccgtgttcagaaagtccttcttcctcaagcgcgtggccgagatcgtgacctgcctcggcatgatgtacttccttgtggagcagtacgccacaccaacactccagaattcagtgagagccttcgacgagctcgccttcggtaccattctcgagcgcgttctcaagctctccaccacctccgtgatcatctggctcctcatgttctacaccttcttccactccttcttcaacgcccttgctgaggctctctacttcggtgatcgccgcttctaccttgcttggtggaacgccaccggtgttggtatgtactggaagacctggaactcacccgtgtacaccttcttcaagcgccacgtgtacctcccactcatcacctccggcacctctccaatggttgcctctatcgtgatcttcttcatctccgccgtgctccacgagatcctcatcggcttcccaacacacatgatctacggctacgccttcgccggcatgttcctccagatccctctcatcatcctcaccagaccactcgagaagtggagaggtaccggttccggcctcggtaacatgatcttctgggtgtccttcaccatcctcggtcagccagcctgcgccctcctctactactaccactggaccaagcgccacatggacgtgtag

SEQ ID NO: 302 - DNA, 1665 bp, Lipomyces starkeyi
atgctcgaccatatctcctccggtacagccacagcctccaccaccaccgtgatgtctaccgctgcccagtccgataccgacaacgaggatatctctaccgtggaccttgtggactcccgcgccgacacccacacctcttccaacgtgatgctccagcagcagaagtccagaagacgcctcatcggtaaggatgccgagcccagaacccagcacccatccggcggtaagtctgagaaggaggagcttaccaagccagacgactccaagggtcccatcaagctctcccacatctaccctatccacgctgtgtcacgcggttctatcctctctcgcgagtctaccacaccaacaccctccttcgtgggcttcagaaacctcgccatgatcgtgctcgccgtttccaacctccgccttgttatcgagaactactccaagtacggcgtgctcatccgcttcgctcgcctcggtatctctcagaaggacatcctctactgcatcttcctcaccgccaccatcccactccacctcttcatcgccatcgttatcgagcgcctcgttgccatcccaaccgtgaactacgttgcctcactctccgagtccgaggacaagaagcgctccaaccctaagatgggccgcaagggcggttccatctctatccttcgcccaaagcctaagtacatgtggcgcctcatcgtgctcctccactccatcaacgctatggcctgcctctgggttaccaccgttgtggtgtacaactccatctaccaccctctcatcggcaccgcctgcgagttccacgccgttatcgtttgccttaaggttgcctcattcgcccttaccaaccgcgacctccgcgagtccatgcttaactctcagccagtgcccgccatctacaacctcgctccctatcccaagaacctcacccttaagaacctctcctacttctggtgggctcccacactcgtttaccagcccgtttacccacgctctccctccttccgcccactcttcttcgttaagcgcatcctcgagatggttggcctctccttcctcatctggttcctttcagcccagtacgctgtgccaacactcgagaactccctcgttcacttccactccctccagttcatgggcatcatggagcgcctcatgaagctcgcctctatctctatggccatctggctcgccggtttcttctgcatcttccagtctggcctcaacgccctcgctgaggttatgcgcttcggtgacagagccttctacgacgactggtggaactccaagtccgtgggtgagtactggagactctggaacaagcccgtgaccaactacttccgccgccacatctacgtgccacttgtgagacgcggttggaactccgccaccgcctccgttatggtgttcttcgtttctgccgtgctccacgagctcgttgttggcgtgcccacacacaacgttatcggcgttgccttctcctccatgatcctccagatccctctcattcaggtgaccgctccactcgagaagatgcacggtcccacctccggtatcatcggcaattgcatcttctggttctccttcttcatcggccagccactcggtgtgctcctctactacttcgcctggaacgtgtccatgtccaaggtgaagatggtggagtcctag

SEQ ID NO: 303 - DNA, 1362 bp, Torulaspora delbrueckii
atgagagacaccgagttcgagcagaagctccgccagagaacacgcgtggatagaacagagcccaccaagccagtttctggttctaccacacccgatacctctcttccagaggacgacgacaaggccaaggctaagggcggcttcttcaattccctccgcgacgagatgtcatcttacagatccgacagaggcagaaagtcttccgacggtcagttcggtgaggagggccttgttccacattacggtcttcccagacttgacgcttgctgctccatccagacaccaatgagacgccgccttcagacagccattgttgcctggcacatttcctccttcgtgttcctcgccgtgctctccatctacgctctctccaatcccatgctctggttcgcctcaatcccctacaccatctacttcatcttcgatagagctcccggtaacggcggtgttgttaagcgcagatctcactggttccgctcccttcccatctggacatggtactgcgagtacttccccatcaatctcgacaagaccgtgccccttacacccacctacaccgagaagaagccctctccatccgagaacaccaagaagtcatccatcttcaaccccaagtcctggaagctcttccgcagatccgagaagtacgagagaaccggtcccagatacatcttcggctaccacccacatggaattggtgcccttggtgctttcggtgccattggtaccgagggttgcggttggtctaagaagttcccaggcatcaacgtgtcactcatgacccttgttgcccagttccacgtgccactcttccgcgattacctcctcgcccttggtatctccgctgttacccgcaagaactccctcaaggttctcgagcgcaaccattccatctgcatcgttgtgggtggcgctagagagtcccttatgtcctccatcggctctgtggatctcgtgcttaagcgccgcaagggtttcatcagactcgctctcgagtccggcaacgtttctctcgttccagtgttcggtttcggcgagaccgattgctacaacatcgtgcacacctccgagaactccttctcccacaaggtgcagctctggatgaagaagaactacggcttcaccatccccatcttctacgccagaggtctcttcaactacgatttcggcttcctcccattccgcacacccatcaccgttctcaccggcaacccaatctacgtggagaagaagattcccaatcccacacaggagcaggtggaccactaccacgacctctacgttgaggagctcaagaagctctactacgacaaccgccacaagtacggctacggtacagtggagatgcagatcgctggctag

SEQ ID NO: 304 - protein, 453 aa, Torulaspora delbrueckii
MRDTEFEQKLRQRTRVDRTEPTKPVSGSTTPDTSLPEDDDKAKAKGGFFNSLRDEMSSYRSDRGRKSSDGQFGEEGLVPHYGLPRLDACCSIQTPMRRRLQTAIVAWHISSFVFLAVLSIYALSNPMLWFASIPYTIYFIFDRAPGNGGVVKRRSHWFRSLPIWTWYCEYFPINLDKTVPLTPTYTEKKPSPSENTKKSSIFNPKSWKLFRRSEKYERTGPRYIFGYHPHGIGALGAFGAIGTEGCGWSKKFPGINVSLMTLVAQFHVPLFRDYLLALGISAVTRKNSLKVLERNHSICIVVGGARESLMSSIGSVDLVLKRRKGFIRLALESGNVSLVPVFGFGETDCYNIVHTSENSFSHKVQLWMKKNYGFTIPIFYARGLFNYDFGFLPFRTPITVLTGNPIYVEKKIPNPTQEQVDHYHDLYVEELKKLYYDNRHKYGYGTVEMQIAG

SEQ ID NO: 305 - DNA, 1362 bp, Torulaspora delbrueckii
atgcgcgataccgagttcgagcagaagctcagacagcgcacacgcgttgacagaaccgagctcacaaagccagtgtccggttccacaacccccgatacctctctcccagaggatgatgacaaggccaaggccaagggcggcttcttcaattcactccgcgacgagatgtcctcctacagatctgacagatcccgcaagtcctccggtggtcagttcggtgaggagggtcttgttccacactacggtcttcccagactcgacgcttgctgctccatccagacaccaatgagacgccgcctccagaccgctgttgttgcctggcatatctcatccttcgtgttcctcgccgtgctctctatctacgccctctccaatcccatgctctggttcgcctccatcccctacaccatctacttcatcttcgacagagctcccggtaacggtggtgtggtgaagagaggctcccattggttccgctccctcccaatctggacctggtactgcgagtacttccccatcaacctcgatcgcaccacacccctcaagcccacctacaccgagaagaagccctcaccctccgagaagaccaagaagtcctccatcttcaaccccaagtcctggaagctcttccgccgcacagagaagtacgagctcacaggtccacgctacatcttcggctaccacccacatggcattggcgctcttggtgccttcggtgctattggtaccgagggctgcggctggtctaagaagttccccggcatcaacgtgtccctcatgaccctcgtggcccagttccacgtgccacttttcagagactacctcctcgccctcggcatctccgccgttacccgcaagaattccctcaaggtgctcgagcgcaaccactccatctgcatcgttgtgggtggcgccagagagtcccttatgtcctccatcggttccgttgaccttctcctcaagcgcagaaagggtttcatccgcctcgccctcgagtccggtaacgtgtctcttgtgcccgtgttcggcttcggcgagaccgattgctacaacatcgtgcacacctccgagaactccttctcccacaaggtgcagctctggatgaagaagaactacggcttcaccatccccatcttctacgccagaggtctcttcaactacgacttcggcttcctcccattccgcacacccatcaccgtgctcaccggcaatcccatctacgtggagaagaagatctccaacccaacacccgagcaggtggaccactaccacgacctttacgtggaggagctcaagaagctctactacgacaaccgccacaagtacggttacggcaccgtggagatgcagatcgccggctag

SEQ ID NO: 306 - protein, 453 aa, Torulaspora delbrueckii
MRDTEFEQKLRQRTRVDRTELTKPVSGSTTPDTSLPEDDDKAKAKGGFFNSLRDEMSSYRSDRSRKSSGGQFGEEGLVPHYGLPRLDACCSIQTPMRRRLQTAVVAWHISSFVFLAVLSIYALSNPMLWFASIPYTIYFIFDRAPGNGGVVKRGSHWFRSLPIWTWYCEYFPINLDRTTPLKPTYTEKKPSPSEKTKKSSIFNPKSWKLFRRTEKYELTGPRYIFGYHPHGIGALGAFGAIGTEGCGWSKKFPGINVSLMTLVAQFHVPLFRDYLLALGISAVTRKNSLKVLERNHSICIVVGGARESLMSSIGSVDLLLKRRKGFIRLALESGNVSLVPVFGFGETDCYNIVHTSENSFSHKVQLWMKKNYGFTIPIFYARGLFNYDFGFLPFRTPITVLTGNPIYVEKKISNPTPEQVDHYHDLYVEELKKLYYDNRHKYGYGTVEMQIAG

SEQ ID NO: 307 - DNA, 1290 bp, Pichia anomala
atgatgcccgccaaggatcttctcgagtccaacgagctttcccagatttccgacgaggacgagttcccatccaagaatcccgacaacgacgcctcttccctcgagaagaacatcgtggttccaaacgatggcagagtgttcaagaaggccgacccaaagagaacacgcggttcatccatcggtaacgttagagtggctccactctccacaccacttccaagacgccttcagacagccgctgtgctctggcataccatctccatccctgtgttcatcaccatcttcttcatctccctcgccatcccaatcttctggctcatcgccgtgccatacctcttctacctcttcacagaccgcaccccctctaacggccaggtgaccaagagatactcagagcgcttcagaaagctctccgtgtggaagtacttctgcaactactaccccgtgaagctcttcaagacccacaacctcgagcccacattcaccgaggtggagatcaaggacgactactaccgccttccaccaccactctcctaccttttcaagatcaacaagaagccctacaagaagctccagaagaccggtcccaagtacatcttcggtctccatccacacggtgttgtgtcactttctggtttcggcggcattggtaccgacggtgccaactggtccaagctcttcccaggtatccccgtttgccttctcacccttcttaaccagttctacatcccactcttccgcgactacctccttgcccttggtatcacatccgctggcaggaacaacgccctcaagatcctcaagcagggtttctctcttgccatcgttgtgggcggtgctcaggagtctcttcttgctagaccagagtccaccgagattgtgcttcagaagcgcaagggcttcatcaagctcgccctcgagacaggcaacgtgtcactcgtgccatgctactgcttcggtgagaacgagctctacaacatcctcgagcccgacgaggattcctactggcgcaagcttcagctctggctcaagaagtccttcggtttcaccattcccttcttccacgccagaggcgtgttcaactacgatttcggcctccttcccttccgcaaggaggttacccttgtgacaggcaagcccatcccagtgccattccttccctcacccaagaagaccgaggtggactactaccacgagctctacgtgaacgagcttcagcgcatcttcgacgagtacaagacaaagttccaagaggacggccagaactccaccctcaagatcgtggagtag

SEQ ID NO: 308 - protein, 429 aa, Pichia anomala
MMPAKDLLESNELSQISDEDEFPSKNPDNDASSLEKNIVVPNDGRVFKKADPKRTRGSSIGNVRVAPLSTPLPRRLQTAAVLWHTISIPVFITIFFISLAIPIFWLIAVPYLFYLFTDRTPSNGQVTKRYSERFRKLSVWKYFCNYYPVKLFKTHNLEPTFTEVEIKDDYYRLPPPLSYLFKINKKPYKKLQKTGPKYIFGLHPHGVVSLSGFGGIGTDGANWSKLFPGIPVCLLTLLNQFYIPLFRDYLLALGITSAGRNNALKILKQGFSLAIVVGGAQESLLARPESTEIVLQKRKGFIKLALETGNVSLVPCYCFGENELYNILEPDEDSYWRKLQLWLKKSFGFTIPFFHARGVFNYDFGLLPFRKEVTLVTGKPIPVPFLPSPKKTEVDYYHELYVNELQRIFDEYKTKFQEDGQNSTLKIVE

SEQ ID NO: 309 - DNA, 2028 bp, Debaryomyces hansenii
atgtcccagaactccctcgacgagaagaacaccacctccgacgacaagaagcagcagcttcgccgcagacatggttcccacgataccccctctgagaacggcctccgcaccccctctagatcctccaccaagtccaactccaagcccaagtcacaccgcaagaagtccctcgtgaacttcgctcccctcaacaccccccttcacaacagactcgagactatgggcgtgatttggcactgcctctccatccccttcttcgtgtccctcttcctcctcgccatttccctcggctggatcatctggatcttcgtgatcctcccctacttcatctggtggtacttcttcgacctccacacacccaccaacggcaagacagtgtaccgcgtgaaggactggatgcagaacatcatcgtgtgggagtggttcgtgaactacttccccatctcaatccacaaggcctgcgatcttgagccaaccttcacccagatgctcgtggacgacaacgagggtaacgacgacgaggaggacctcatctccgaggactcccgcaccatcatcgacaagctcttcaagaccctcggcctcagaaagcgcctcaacgactccgactcccacaacgtgctcaacaccccctcctctgacaagaagttcgacaaggccctcaagtataagaaggagtccaccggccctcgctacatcttcggctaccacccacatggcgtgatttctatgggcgtgatgggcgccttcgccaccaacgtgattcgcaacgagccctaccagccacccttctcattcctcaagtccttcttccacgatccctccaagtacacccgcctccttcccggcatcggcaacatcttcccactcaccctcaccacccagttcaccctcccattcttccgcgactaccttatgtccctcggtctcacctccgcctcctacaagaacatcaagtccatcatcaacaacggcgacaactccgtgtgccttgtggttggcggcgctcaggagtcccttctcaacactatggtgtctcccagactccgcatcggcaacggctacaagaacgacgagaccgacgagtctggtgatgagtccgagccaatggtgaaggagtacaaccccaaggaggtggagcactactcaatcaaggagcagatggacgagaacctcgacgagaacaagcacgagtcctccgagtccgactccaacctcgataccgagaagggccaggagaagctcgactctgagaagctcatcaagaccgagaccgacaacgccgaccagcccggcgagaacaaggacaagaacctcaacgaccataacgagaccgagaccgagaagcccggtcagtccgaggagaaggagtcccaggatgacgattcatcctccccacgccagattcagctcgttctcaacaagcgcaagggcttcgtgaagctcgccatcgagctcggcaacgtttgcctcgtgcccacattcggtttcggtgaggctgacatctaccgcattgccaatcccaagcccggctcccttggctccagattccaagagtggatgaagtcaaccttccagttcaccgtgcccttcttctccgcacgcggcgtgttcatctacgacttcggtttccttcccttccgcaaccccatcgacatctgcatgggcgagcccatctacgttccctctggcctcatcgccgattacaagcttaagcatcccggcttcgattccgacgaggaggtggagcagaacaacaagcagaagaaggaggacgagaagggcgacgagacagattccaagaagaaggacaagaaggacttcaagaagaagggcaagaaggacttcaagaccgagaagaaggaggactccaagtccaaggacaagaagcgcgagaagaagatcaagatcccctccgagatcctcaaccactaccacaagctctacgtggacggcctcaagaaggtgtacgaggagaacaagtgtaagttcggctacgaggacgtggagctcatcatcatcgagtag

SEQ ID NO: 310 - protein, 675 aa, Debaryomyces hansenii
MSQNSLDEKNTTSDDKKQQLRRRHGSHDTPSENGLRTPSRSSTKSNSKPKSHRKKSLVNFAPLNTPLHNRLETMGVIWHCLSIPFFVSLFLLAISLGWIIWIFVILPYFIWWYFFDLHTPTNGKTVYRVKDWMQNIIVWEWFVNYFPISIHKACDLEPTFTQMLVDDNEGNDDEEDLISEDSRTIIDKLFKTLGLRKRLNDSDSHNVLNTPSSDKKFDKALKYKKESTGPRYIFGYHPHGVISMGVMGAFATNVIRNEPYQPPFSFLKSFFHDPSKYTRLLPGIGNIFPLTLTTQFTLPFFRDYLMSLGLTSASYKNIKSIINNGDNSVCLVVGGAQESLLNTMVSPRLRIGNGYKNDETDESGDESEPMVKEYNPKEVEHYSIKEQMDENLDENKHESSESDSNLDTEKGQEKLDSEKLIKTETDNADQPGENKDKNLNDHNETETEKPGQSEEKESQDDDSSSPRQIQLVLNKRKGFVKLAIELGNVCLVPTFGFGEADIYRIANPKPGSLGSRFQEWMKSTFQFTVPFFSARGVFIYDFGFLPFRNPIDICMGEPIYVPSGLIADYKLKHPGFDSDEEVEQNNKQKKEDEKGDETDSKKKDKKDFKKKGKKDFKTEKKEDSKSKDKKREKKIKIPSEILNHYHKLYVDGLKKVYEENKCKFGYEDVELIIIE

SEQ ID NO: 311 - DNA, 1695 bp, Candida zeylanoides
atggagaatgacgctgcccaccttaccaggaggaagccaaagcatccacttgccggtgccgattctacccacagagacgctgacagacgcccaacaacaccaacacgctctccaccactcgctcgccttaagctccatatcgctcctatcaacacacccatgaagcaccagctccagacccttggcctcatctggcacaccatcctcatccctttcttcatgttcgtgttcctcttcaccctctaccttggctgggttgcctggcttatgatgatccttccctacttcatctggtggtacggcttcgatctccacacacccgctaacggtaagacccagtaccgctacaaggattgggtgcgcaacctcatcgtttgggagtggttcgtggattacttcccaatccgcgtgcacaaggcttgcgagcttgagccaaccttccttcacgtgcttgtggaggagacacttgcccagccagacgacgaggaggatcttgtgctcgagaattcaagaaccctccttgacaccgtgttcaagcgccttggcctccagaagcgcatcaatgtgatcgacggttaccttccaccagcttctggtggtcgcaagaagcacaagaaggtgcttaccggcccacgctacatcttcggttaccacccacatggcgttatctctatgggcgtgatgggcacattcggcaccaatgctattcgcaacgagcccttcgagccaccactcaagttcctcaagcctctcttccatgatccatcaggtaaggagcgcctcctcccagacattgagaagatcttcccttccaccctctccacacagttcacactcccattcttccgcgactacctcctttcccttggtcttacctctgccgccgctaagaacatcaagtccctgatccagaacggcgacaactccatcgttcttgttgtgggtggtgctcaggagtcacttctcaacgacgttgttgcttctcacgcccacgtgggtaacggctacacaggtccaagacagaaggaggatccacagcagcatcagcagcagcagctccttctcctccttcttccactccttgacacctctggcccaccacagtctagagagatccgccttgttctcaacaagcgcaagggtttcgtgaagatcgccatcgagctcggcaacatctcactcgtgccaatcttcgctttcggcgaggccgacatctacaacgtgaacattcccgacaagggcacatggggtgagcagttccagctctggatgaagaaggtgttctccttcacactcccattcttctctgccagaggcgtgttcatctacgacttcggcttcctcccttacagacatcccatcaatctttgcatgggccgccctattcacattccagctggtacattgcaggagtacaagctcaagcacccagattgggacgagtcaggcgataagcccgctgctacacatctcgatgccgtgaagcacacctcttctagatccaactccttctccaacctcttcaagctcaaccagaagtccgctgctcccaagcccacaccctctaagacaatcgtgccacccaagcttctcgaccactaccatcgcctttacatggacgagctcaagcgcgtgtacgaggataacaaggacaagttcggctactccgacgttaagctcaacatcgtggagtag

SEQ ID NO: 312 - protein, 564 aa, Candida zeylanoides
MENDAAHLTRRKPKHPLAGADSTHRDADRRPTTPTRSPPLARLKLHIAPINTPMKHQLQTLGLIWHTILIPFFMFVFLFTLYLGWVAWLMMILPYFIWWYGFDLHTPANGKTQYRYKDWVRNLIVWEWFVDYFPIRVHKACELEPTFLHVLVEETLAQPDDEEDLVLENSRTLLDTVFKRLGLQKRINVIDGYLPPASGGRKKHKKVLTGPRYIFGYHPHGVISMGVMGTFGTNAIRNEPFEPPLKFLKPLFHDPSGKERLLPDIEKIFPSTLSTQFTLPFFRDYLLSLGLTSAAAKNIKSLIQNGDNSIVLVVGGAQESLLNDVVASHAHVGNGYTGPRQKEDPQQHQQQQLLLLLLPLLDTSGPPQSREIRLVLNKRKGFVKIAIELGNISLVPIFAFGEADIYNVNIPDKGTWGEQFQLWMKKVFSFTLPFFSARGVFIYDFGFLPYRHPINLCMGRPIHIPAGTLQEYKLKHPDWDESGDKPAATHLDAVKHTSSRSNSFSNLFKLNQKSAAPKPTPSKTIVPPKLLDHYHRLYMDELKRVYEDNKDKFGYSDVKLNIVE

SEQ ID NO: 313 - DNA, 1233 bp, Lipomyces starkeyi
atgtccgagaaggccgagattgaggttcccccacagaagtccaccttcccaagatccgttcatttcgctccactccacatcccactcgagcgcagacttcagacactcgctgtgctcttccacacagttgctcttccctactgcattggcctcttcttccttatgcttgccttcccacccttctggccactcctcgtgatgtacgtgatctacgcctacggtttcgatcactcatcctccaatggtgagatttcccgccgcagatctccactcttcagaagactcccactcttccgcctctactgcgactacttccccatccacatccacagagaggttccacttgagccaacattccccggcagacttagagagccatcaggtcttgtggagagatggatcgccaagatgttcggcgttcaagacgctgtggttgagggtaacgagtctgatgtgaaggctaccgccaatggtaacggcaccaccaaggagatcggtccaacctacgttttcggctaccacccacacggtatcgtttcccttggtgccttcggcgctattggtacagagggtgctggttgggagaagcttttcccaggtattcccgtttcactcctcacactcgagacaaacttctcccttcccttcttccgcgagtaccttctctcccttggtatcgcttccgtgtcccgccgctcttgcacaaacctccttaagcacgatcagtccatctgcatcgtgattggcggcgctcaggagtctcttcttgctgagcccggtacactcgatcttatcctcgtgaagcgccgcggtttcgttaagcttgccatgtcaaccgctcgcgtttctgaccagcccatctgccttgttcccatcctctccttcggcgagaatgatgtgtacgatcaggttcgcggcgacagatcatccaagctctacaagatccagaccttcatcaagaaggccgccggtttcacccttccacttatgtacgcccgcggcatcttcaactacgatttcggtctcatgccctacagacgccagatgacactcgttgttggcaagcccatcgctgttccatacgttgcccagccaacagaggccgagattgaggtgtaccacaagcagtacatggacgagctcagacgcctctgggacacctacaaggatgattacttcgtggaccataagggcaagggcgtgaagaactccgagatgcgcttcgtggagtag

SEQ ID NO: 314 - protein, 410 aa, Lipomyces starkeyi
MSEKAEIEVPPQKSTFPRSVHFAPLHIPLERRLQTLAVLFHTVALPYCIGLFFLMLAFPPFWPLLVMYVIYAYGFDHSSSNGEISRRRSPLFRRLPLFRLYCDYFPIHIHREVPLEPTFPGRLREPSGLVERWIAKMFGVQDAVVEGNESDVKATANGNGTTKEIGPTYVFGYHPHGIVSLGAFGAIGTEGAGWEKLFPGIPVSLLTLETNFSLPFFREYLLSLGIASVSRRSCTNLLKHDQSICIVIGGAQESLLAEPGTLDLILVKRRGFVKLAMSTARVSDQPICLVPILSFGENDVYDQVRGDRSSKLYKIQTFIKKAAGFTLPLMYARGIFNYDFGLMPYRRQMTLVVGKPIAVPYVAQPTEAEIEVYHKQYMDELRRLWDTYKDDYFVDHKGKGVKNSEMRFVE

SEQ ID NO: 315 - DNA, 1110 bp, Mucor circinelloides
atgaaggagcccgtgtccaaggagaacaccgataccaagtccgatcgcaagatcgcccttccagacatcaagaaggtgtcccaggtgatcccaaacgttccagaggttcagtgggctccactcacaggcatcccattcgagcgcagaattcagatggccgtggttctcatgtggatcttcctcctcggtaactgcctcacactcttctgctgctcactcttccttcccttcctttggccactccacatcgcctacatcatctacctctacagagatcagtccgctgagaacggtggcagaagatctgactggttccgccgccttcccatttggaactactacgctggttacttcccagccaagcttgttaaggagcaggacctcgatcccaagaagaactacgtgttcggttcacaccctcatggcatcatctccatctcttccttcgcctctttcgctacagaggctaccggtttctcccagctcttcccaggcatcattccctctctcctcacactcaccaccaacttcaagttccctatcttcagggacatcattctcgccctcggcatcgcttctgtttccagacactcatgcgagaagatcctctcctctggtcccggtagatccatcgtgatcgtgatcggtggtgcttccgagtcccttaacgctagaccaggtatcgccgatctcgtgctcaagaagcgcctcggcttcattagaattgctatcagacatggtgccgacctagttcccgtgttctccttcggcgagaatgagctctacgagcaggtggataactccaccggttcctggctttggaaggcccagaagaagatgcagcaggcccttggtttcacaatgccacttttccatgcccgcggcatcttcaactacaacgtgggtctaatcccataccgccatccaatcgttaccgtggttggcaagccaatcccagtgccaaagatgaagccaggtcagacagagcccacacaggagcagcttctcgagacacaggctctctacatcgaggagctcgagtccatctacaacaagtacaaggacgtgtacgccaaggaccgcaagcaggatctccgcatcgtttcctag

SEQ ID NO: 316 - protein, 369 aa, Mucor circinelloides
MKEPVSKENTDTKSDRKIALPDIKKVSQVIPNVPEVQWAPLTGIPFERRIQMAVVLMWIFLLGNCLTLFCCSLFLPFLWPLHIAYIIYLYRDQSAENGGRRSDWFRRLPIWNYYAGYFPAKLVKEQDLDPKKNYVFGSHPHGIISISSFASFATEATGFSQLFPGIIPSLLTLTTNFKFPIFRDIILALGIASVSRHSCEKILSSGPGRSIVIVIGGASESLNARPGIADLVLKKRLGFIRIAIRHGADLVPVFSFGENELYEQVDNSTGSWLWKAQKKMQQALGFTMPLFHARGIFNYNVGLIPYRHPIVTVVGKPIPVPKMKPGQTEPTQEQLLETQALYIEELESIYNKYKDVYAKDRKQDLRIVS

SEQ ID NO: 317 - DNA, 1218 bp, Phaffia rhodozyma
atggaccctcaaaccgacccttcctctcctactcagtctcctgttcttcctaaggagggcctttctttgcgccctaccaggtccaagtcctccttggtggagtttgggtcctcttccatctctggccttcgcgataacatctccaccggcatcaacaccttgtccaccgggctcaagacccaggttgagaagaggcgcaaggatcttcctaagggcatcgagatcaagttcgctcccttgaaggttcctcgcaatcgcagacttcagaccggcgctgttgctctttggtccaccttgcttcccatctgtacctccatcttcctctggatgtgttccatccctcgcttgtggcctcttctcatcccctacctcatctgggtgttctacatcgatagggctcctgttttgggcggtcgtcctaagaggtggttgagacgcatgggcatttggaagcacttcgccaactactatcccgtgtcccttgttcaagaggcttcccttcccttggaccgcaagtacatcttcgggtaccaccctcacggtgttatcggcatgggtgctttcgccaacttcgctactgagggtaccaacttctccaagatcttccccggcatcgagcctcacctcctcaccctcgctcccaacttcaagattcctctcttccgcgatctcctcttgctcctcgggatgtgctccgtctctaagcgctcctgctcctctattcttagaaagggccctcccgggactgctatcgtgatcgttgtgggtggtgccactgagtctttgagggctcaccctggcactgctgatcttaccctcaagtcccgcatgggcttcatcaagatcgccatcaacgagggcgtggatctcgttcccgtgttctccttcggcgagaacgacatctacgatcagttggccaacgagcgcggcacccagatctacaagctccagaagcgcttccagtctatcttcgggttcactctccctctctttcacggtcgcggcctcttcaactattccgtgggtctcatgccctatcgtcagcccattgtttccgttgctggcaggcccattcgtgttgttcagtgcaacaaccctacctctgagcagctccaagagactcagggtcgctacattgaggagcttctccgcatctgggacacctacaaggacgtgtacgcccgcaatcgcacaaaggagctcactctcgtggattag

SEQ ID NO: 318 - protein, 405 aa, Phaffia rhodozyma
MDPQTDPSSPTQSPVLPKEGLSLRPTRSKSSLVEFGSSSISGLRDNISTGINTLSTGLKTQVEKRRKDLPKGIEIKFAPLKVPRNRRLQTGAVALWSTLLPICTSIFLWMCSIPRLWPLLIPYLIWVFYIDRAPVLGGRPKRWLRRMGIWKHFANYYPVSLVQEASLPLDRKYIFGYHPHGVIGMGAFANFATEGTNFSKIFPGIEPHLLTLAPNFKIPLFRDLLLLLGMCSVSKRSCSSILRKGPPGTAIVIVVGGATESLRAHPGTADLTLKSRMGFIKIAINEGVDLVPVFSFGENDIYDQLANERGTQIYKLQKRFQSIFGFTLPLFHGRGLFNYSVGLMPYRQPIVSVAGRPIRVVQCNNPTSEQLQETQGRYIEELLRIWDTYKDVYARNRTKELTLVD

SEQ ID NO: 319 - DNA, 1041 bp, Rhodotorula glutinis
atgggtgcccaggaggaggtggagtacgatcagtccgagcactccaagatcaagttcgtgccattcgttgtgcccagacacagacgcctccagaccttctccgtgttcctctggaccacagctcttcccatctcactcggcatcttctgcattctctgctccttcccaccactctggcccctcgtgattggctacctcacctgggtgttcctcattgaccaggctcccatgagaggtggccgcccacaggcctggctcaggaagtctagagtgtgggagtggttcgctggttactaccccgtgtcactcatcaagtctgctgaccttcccccagatcagcgctacgtgttcggctaccacccacacggcgtgatcggcatgggtgctattgctaacttcggtacagatgccaccggcttctcccgcctcttcccaggcattacaccacatctcctcaccctcgcttccaacttcaagctcccagtgttccgcgagctccttcttggtctcggtatctcctccgtgtccatgaagtcctgccagaacatcctcagacagggcccaggctcctccatcacaattgtggttggtggcgccgctgagtcactttctgctcacccaggcacagctgacctcacccttaagcgccgcaagggtttcatcaagcttgccattcgcacaggcgcctcacttgtgccagtgttctccttcggcgagaacgacatcttcaaccagctctccaacgagcgcggcacccgcctttacaagctccagaagagattccaagccgtgttcggcttcacacttcccatcttcttcggtcgcggcctcttcaactacaacatgggccttatgccctacagacaccccatcgtttccgtggtgggcagacccatcaaggtgaagcagaaggaccatccctccacagccgaccttgaggaggttcaagagcgctacatcgccgagctcaagcgcatttgggaggattacaaggaggtgtacgccaagtcccgcaccaaggagctcaccatcattgcctag

SEQ ID NO: 320 - protein, 346 aa, Rhodotorula glutinis
MGAQEEVEYDQSEHSKIKFVPFVVPRHRRLQTFSVFLWTTALPISLGIFCILCSFPPLWPLVIGYLTWVFLIDQAPMRGGRPQAWLRKSRVWEWFAGYYPVSLIKSADLPPDQRYVFGYHPHGVIGMGAIANFGTDATGFSRLFPGITPHLLTLASNFKLPVFRELLLGLGISSVSMKSCQNILRQGPGSSITIVVGGAAESLSAHPGTADLTLKRRKGFIKLAIRTGASLVPVFSFGENDIFNQLSNERGTRLYKLQKRFQAVFGFTLPIFFGRGLFNYNMGLMPYRHPIVSVVGRPIKVKQKDHPSTADLEEVQERYIAELKRIWEDYKEVYAKSRTKELTIIA

SEQ ID NO: 321 - DNA, 1110 bp, Mortierella alpina; identical to SEQ ID NO: 315

SEQ ID NO: 322 - protein, 369 aa, Mortierella alpina; identical to SEQ ID NO: 316

SEQ ID NO: 323 - DNA, 5303 bp, Artificial Sequence; identical to SEQ ID NO: 248
  plasmid pKR278

SEQ ID NO: 324 - DNA, 8358 bp, Artificial Sequence
  plasmid pKR1274
gtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatcgatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatgtcgaatcgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggatctggccggccggatctcgtacgctagcctaagtacgtactcaaaatgccaacaaataaaaaaaaagttgctttaataatgccaaaacaaattaataaaacacttacaacaccggattttttttaattaaaatgtgccatttaggataaatagttaatatttttaataattatttaaaaagccgtatctactaaaatgatttttatttggttgaaaatattaatatgtttaaatcaacacaatctatcaaaattaaactaaaaaaaaaataagtgtacgtggttaacattagtacagtaatataagaggaaaatgagaaattaagaaattgaaagcgagtctaatttttaaattatgaacctgcatatataaaaggaaagaaagaatccaggaagaaaagaaatgaaaccatgcatggtcccctcgtcatcacgagtttctgccatttgcaatagaaacactgaaacacctttctctttgtcacttaattgagatgccgaagccacctcacaccatgaacttcatgaggtgtagcacccaaggcttccatagccatgcatactgaagaatgtctcaagctcagcaccctacttctgtgacgtgtccctcattcaccttcctctcttccctataaataaccacgcctcaggttctccgcttcacaactcaaacattctctccattggtccttaaacactcatcagtcatcaccgcggccgcaaaccatggaggtccgacgacgaaagatagacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttactatttggcctacaactacaagcagaaccagtagcggccgcatttcgcaccaaatcaatgaaagtaataatgaaaagtctgaataagaatacttaggcttagatgcctttgttacttgtgtaaaataacttgagtcatgtacctttggcggaaacagaataaataaaaggtgaaattccaatgctctatgtataagttagtaatacttaatgtgttctacggttgtttcaatatcatcaaactctaattgaaactttagaaccacaaatctcaatcttttcttaatgaaatgaaaaatcttaattgtaccatgtttatgttaaacaccttacaattggttggagaggaggaccaaccgatgggacaacattgggagaaagagattcaatggagatttggataggagaacaacattctttttcacttcaatacaagatgagtgcaacactaaggatatgtatgagactttcagaagctacgacaacatagatgagtgaggtggtgattcctagcaagaaagacattagaggaagccaaaatcgaacaaggaagacatcaagggcaagagacaggaccatccatctcaggaaaaggagctttgggatagtccgagaagttgtacaagaaattttttggagggtgagtgatgcattgctggtgactttaactcaatcaaaattgagaaagaaagaaaagggagggggctcacatgtgaatagaagggaaacgggagaattttacagttttgatctaatgggcatcccagctagtggtaacatattcaccatgtttaaccttcac

SEQ ID NO: 325 - DNA, 1251 bp, Glycine max
atggtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaactggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacaacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgaggggcaggactgagtggaggcccaaacctgtgaacaactttggtgttgtgaaccaggttccagcagaaagcacctaa

SEQ ID NO: 326 - DNA, 9592 bp, Artificial Sequence
  plasmid pTC4
  misc_feature (3725)..(3725): n is a, c, g, or t
ggccgctacatggccacgtgcatgaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggacgactctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctttgctctagactggaattcgtcgactctagaggatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacctaatagtgagatccaacacttacgtttgcaacgtccaagagcaaatagaccacgnacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcggtcgacgagctccctatagtgagtcgtattagaggccgacttggccaaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacaaaatattaacgtttacaatttcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagctgacttggtcagcggccggccgcagatttaggtgacactatagaatatgcatcactagtaagctaagcttgatccatgcccttcatttgccgctattaattaatttggtaacagtagtccgtactaatcagttacttatccttcctccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgaatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatatctgcaatctcggcccaggttttcatcatcaagaaccagttcaatatcctagtacaccgtattaaagaatttaagatatactaacagcggccgctgacacaatagcccttcttccctgtttccagcttttctccttctctctctctccatcttcttcttcttcttcactcagtcagatccaactcctcagataacacaagaccaaacccgctttttctgcatttctagactagacgttctaccggagaagcgaccttagaaattcattatggtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaactggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacaacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgaggggcaggactgagtggaggcccaaacctgtgaacaactttggtgttgtgaaccaggttccagcagaaagcacctaagatttgaaatggttaacgattggagttgcatcagtctccttgctatgtttagacttattctggttccctggggagagttttgcttgtgtctatccaatcaatctacatgtctttaaatatatacaccttctaatttgtgatactttggtgggtaagggggaaaagcagcagtaaatcgc

SEQ ID NO: 327 - DNA, 28 bp, Artificial Sequence
  rimer GmTE2 5-1
aaacgcgtgtggcaacagctgctacttc

SEQ ID NO: 328 - DNA, 51 bp, Artificial Sequence
  primer GmTE2 3-1
gctcttgtcaagatttcaccgaattcttaagttttggagtcacgtaaaagc

SEQ ID NO: 329 - DNA, 51 bp, Artificial Sequence
  primer GmTE2 5-2
gcttttacgtgactccaaaacttaagaattcggtgaaatcttgacaagagc

SEQ ID NO: 330 - DNA, 60 bp, Artificial Sequence
  primer GmTE2 3-2
tcgcggccgctgtacaggaacaattgtgattaattagtcacaatctcagcaccattttcc

SEQ ID NO: 331 - DNA, 4738 bp, Artificial Sequence
  plasmid pKR1258
aattcaggaaacgcgtgtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaacttaagaattcggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacgacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgactaattaatcacaattgttcctgtacagcggccgcgacctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcag

SEQ ID NO: 332 - DNA, 1164 bp, Glycine max
atgggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgaccgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattgggtgagtactaccaatttgatgacacaccattttacaaggcactgtggagagaagcgagagagtgcctctatgtggagccagatgaaggaacatccgagaagggcgtgtattggtacaggaacaagtattga

SEQ ID NO: 333 - DNA, 10303 bp, Artificial Sequence
  plasmid pBS43
  misc_feature (3347)..(3347): n is a, c, g, or t
gtcgactctagaggatccaattccaatcccacaaaaatctgagcttaacagcacagttgctcctctcagagcagaatcgggtattcaacaccctcatatcaactactacgttgtgtataacggtccacatgccggtatatacgatgactggggttgtacaaaggcggcaacaaacggcgttcccggagttgcacacaagaaatttgccactattacagaggcaagagcagcagctgacgcgtacacaacaagtcagcaaacagacaggttgaacttcatccccaaaggagaagctcaactcaagcccaagagctttgctaaggccctaacaagcccaccaaagcaaaaagcccactggctcacgctaggaaccaaaaggcccagcagtgatccagccccaaaagagatctcctttgccccggagattacaatggacgatttcctctatctttacgatctaggaaggaagttcgaaggtgaaggtgacgacactatgttcaccactgataatgagaaggttagcctcttcaatttcagaaagaatgctgacccacagatggttagagaggcctacgcagcaggtctcatcaagacgatctacccgagtaacaatctccaggagatcaaataccttcccaagaaggttaaagatgcagtcaaaagattcaggactaattgcatcaagaacacagagaaagacatatttctcaagatcagaagtactattccagtatggacgattcaaggcttgcttcataaaccaaggcaagtaatagagattggagtctctaaaaaggtagttcctactgaatctaaggccatgcatggagtctaagattcaaatcgaggatctaacagaactcgccgtgaagactggcgaacagttcatacagagtcttttacgactcaatgacaagaagaaaatcttcgtcaacatggtggagcacgacactctggtctactccaaaaatgtcaaagatacagtctcagaagaccaaagggctattgagacttttcaacaaaggataatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacacgctcgagctcatttctctattacttcagccataacaaaagaactcttttctcttcttattaaaccatggtacgtcctgtagaaaccccaacccgtgaaatcaaaaaactcgacggcctgtgggcattcagtctggatcgcgaaaactgtggaattgatcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggccaacagttcctgattaaccacaaaccgttctactttactggctttggtcgtcatgaagatgcggacttacgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaagtgcacgggaatatttcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatgaatcaacaactctcctggcgcaccatcgtcggctacagcctcggtggggaattccccgggggtacctaatagtgagatccaacacttacgtttgcaacgtccaagagcaaatagaccacgnacgccggaaggttgccgcagcgtgtggattgcgtctcaattctctcttgcaggaatgcaatgatgaatatgatactgactatgaaactttgagggaatactgcctagcaccgtcacctcataacgtgcatcatgcatgccctgacaacatggaacatcgctatttttctgaagaattatgctcgttggaggatgtcgcggcaattgcagctattgccaacatcgaactacccctcacgcatgcattcatcaatattattcatgcggggaaaggcaagattaatccaactggcaaatcatccagcgtgattggtaacttcagttccagcgacttgattcgttttggtgctacccacgttttcaataaggacgagatggtggagtaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatcaaacttcggtactgtgtaatgacgatgagcaatcgagaggctgactaacaaaaggtacatcggtcgacgagctccctatagtgagtcgtattagaggccgacttggccaaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacaaaatattaacgtttacaatttcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagctgacttggtcagcggccgcagatttaggtgacactatagaatatgcatcactagtaagcttgatccatgcccttcatttgccgctattaattaatttggtaacagtagtccgtactaatcagttacttatccttcctccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgaatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatatctgcaatctcggcccaggttttcatcatcaagaaccagttcaatatcctagtacaccgtattaaagaatttaagatatactaacgtagcccatcgaattcccatatactaatatttgcttgtattgatagcccctccgttcccaagagtataaaactgcatcgaataatacaagccactaggcatgggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgaccgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattgggtgagtactaccaatttgatgacacaccattttacaaggcactgtggagagaagcgagagagtgcctctatgtggagccagatgaaggaacatccgagaagggcgtgtattggtacaggaacaagtattgatggagcaaccaatgggccatagtgggagttatggaagttttgtcatgtattagtacataattagtagaatgttataaataagtggatttgccgcgtaatgactttgtgtgtattgtgaaacagcttgttgcgatcatggttataatgtaaaaataattctggtattaattacatgtggaaagtgttctgcttatagctttctgcctaaaaaaaaagaattcctgcagcccgggtctagacatggccacgtgcatgaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggacgactctcaattatttaaacgagagtaaacatatttgactttttggttatttaacaaattattatttaacactatatgaaattttttttttttatcagcaaagaaataaaattaaattaagaaggacaatggtgtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagctttgctctagactggaattc

SEQ ID NO: 334 - DNA, 50 bp, Artificial Sequence
  primer FAD2-1 5-1
gcggccgcggtacctaattaactaggtctagcaaaggaaacaacaatggg

SEQ ID NO: 335 - DNA, 48 bp, Artificial Sequence
  primer FAD2-1 3-2
gggacaaacacttcatcacgagatcttagtcaagggaacctgtgttgg

SEQ ID NO: 336 - DNA, 48 bp, Artificial Sequence
  primer FAD2-1 5-2
ccaacacaggttcccttgactaagatctcgtgatgaagtgtttgtccc

SEQ ID NO: 337 - DNA, 34 bp, Artificial Sequence
  primer FAD2-1 3-2
acacgcgtttaaaatattggcttgattgcattgg

SEQ ID NO: 338 - DNA, 4584 bp, Artificial Sequence
  plasmid PCRblunt-Fad2-1
ttgtaatacgactcactatagggcgaattgggccctctagatgcatgctcgagcggccgccagtgtgatggatatctgcagaattcagggcggccgcggtacctaattaactaggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgactaagatctcgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattttaaacgcgtgtcctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaa

SEQ ID NO: 339 - DNA, 5797 bp, Artificial Sequence
  plasmid pKR1259
cgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcagggcggccgcggtacctaattaactaggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgactaagatctcgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattttaaacgcgtgtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaacttaagaattcggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacgacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgactaattaatcacaattgttcctgtacagcggccgccctgaattccagcacactggcggccgttactagtggatccgagctcggtaccaagcttgatgcatagcttgagtattctaa

SEQ ID NO: 340 - DNA, 7590 bp, Artificial Sequence
  plasmid pKR1261
aattgttcctgtacagcggccgccctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcagggcggccgcggtacctaattaactaggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgactaagatctcgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattttaaacgcgtgtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaacttaagaattcggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacgacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgactaattaatcacaattcttaagttttggagtcacgtaaaagccaatcacgacgcataccattcttccctgatccagaaacccaagtgtccacttgaactatgtcaccccatgtaggatagcgttccaccacaacctgcatccgagtaaccacccatatcaagttctttttgcacatttctggcgtggaaccaaagccatcaccaagaagcccagcacttttaacatgattaagtgcagtttcttgcaaatggttcattactgtttctatagatgcggtacgatcagcaccaatctcatatgatctaatagaaaagttttcacggaacacaagaccatcctgaacaatttttcctatcccaaaggggtcaataagcatgtcaggtcgccgtggcttccaatcaagcatcatccactgcttttcagcggccaagaaaattgttgtgatagcagcaagaagcatgctccaatcaggcaactggttgataaaagttctggggggaggcgaaggtagatcatcatcatgcttgaagctttctttagatgtaacaactgtggttccattaattttcgaaggggcttgcgcctttgccttcaagccaccagaagacgcagatttggattttagtcctccaaggtttgcaggcccaccaccaagtttgctgcctgctccaccagagtccggcgagggtgaagtaacagggaaaaatgatgaagtagcagctgttgccacacgcgtttaaaatattggcttgattgcattggttgcctccattgcatggtaatgtggcattgtagagaagagatggtgagccacatgagtatcagttatgtgatgaaacaccttgttcagaatcccataatctctgtccatagttgccaaagctcccttcagccagtcccattctgatgaatcgtaatgaggcaaggcaaagtgtgtgtgctgcaaatatgtgatagtcacaagaaaaccgttcacaatgagcaaaggcaccccataaacacatagcagccaaaccaaccctttcagggttgcaacacggtagagagagtaagtcacagaaaacaaagcaacatcagagacatagatcagaagcctctcacggttagaatatatgggagcataagggtggtagtggcttgcaaaactatcatagggtctaccagagacattgaaggctaaatacataggccaccctattgtgagtgtgacgagaagagaaacagcccttcctagagggttgtttaagtacttggaaaaccatgcaactttggattttggttttgggacaaacacttcatcacgagatcttagtcaagggaacctgtgttggagtgatggcggcgatggcttattttccatgagaaataagggactaaaagtgttgagtgaagggtcaaacccacaacatcatcaacccattggtacttgctgaaggcatggtgaccacactcgtgagcaatcacccacacaccagtgagaaggcaaccttggagaacccaatagattggccatgcaatgagggaaaagggttgaggaaggaggtggaagtaggtggtggcaatgtagaaaatgaaggcaaatgaaaggtcataaacaacataggagaatgaagtgaggagggagcgctgaaagcagtgtggtggaattgctttcttgagttggccaacagtgaatggtggctttgtgtttggaacccttgagagaggcttcttcccttgaacttccactttggccacacgacctctacctcccattgttgtttcctttgctagacctagttaattaggtaccgcggccgccctg

SEQ ID NO: 341 - DNA, 4993 bp, Artificial Sequence
  plasmid pKR123R
  misc_feature (1126)..(1126): n is a, c, g, or t
ctagacctgcaggatataatgagccgtaaacaaagatgattaagtagtaattaatacgtactagtaaaagtggcaaaagataacgagaaagaaccaatttctttgcattcggccttagcggaaggcatatataagctttgattattttatttagtgtaatgatttcgtacaaccaaagcatttatttagtactctcacacttgtgtcgcggccgcttggggggctatggaagactttcttagttagttgtgtgaataagcaatgttgggagaatcgggactacttataggataggaataaaacagaaaagtattaagtgctaatgaaatatttagactgataattaaaatcttcacgtatgtccacttgatataaaaacgtcaggaataaaggaagtacagtagaatttaaaggtactctttttatatatacccgtgttctctttttggctagctagttgcataaaaaataatctatatttttatcattattttaaatatcttatgagatggtaaatatttatcataattttttttactattatttattatttgtgtgtgtaatacatatagaagttaattacaaattttatttactttttcattattttgatatgattcaccattaatttagtgttattatttataatagttcattttaatctttttgtatatattatgcgtgcagtacttttttcctacatataactactattacattttatttatataatatttttattaatgaattttcgtgataatatgtaatattgttcattattatttcagattttttaaaaatatttgtgttattatttatgaaatatgtaatttttttagtatttgattttatgatgataaagtgttctaaattcaaaagaagggggaaagcgtaaacattaaaaaacgtcatcaaacaaaaacaaaatcttgttaataaagataaaactgtttgttttgatcactgttatttcgtaatataaaaacattatttatatttatattgttgacaaccaaatttgcctatcaaatctaaccaatataatgcatgcgtggcaggtaatgtactaccatgaacttaagtcatgacataataaaccgtgaatctgaccaatgcatgtacctanctaaattgtatttgtgacacgaagcaaatgattcaattcacaatggagatgggaaacaaataatgaagaacccagaactaagaaagcttttctgaaaaataaaataaaggcaatgtcaaaagtatactgcatcatcagtccagaaagcacatgatatttttttatcagtatcaatgcagctagttttattttacaatatcgatatagctagtttaaatatattgcagctagatttataaatatttgtgttattatttatcatttgtgtaatcctgtttttagtattttagtttatatatgatgataatgtattccaaatttaaaagaagggaaataaatttaaacaagaaaaaaagtcatcaaacaaaaaacaaatgaaagggtggaaagatgttaccatgtaatgtgaatgttacagtatttcttttattatagagttaacaaattaactaatatgattttgttaataatgataaaatattttttttattattatttcataatataaaaatagtttacttaatataaaaaaaattctatcgttcacaacaaagttggccacctaatttaaccatgcatgtacccatggaccatattaggtaaccatcaaacctgatgaagagataaagagatgaagacttaagtcataacacaaaaccataaaaaacaaaaatacaatcaaccgtcaatctgaccaatgcatgaaaaagctgcaatagtgagtggcgacacaaagcacatgattttcttacaacggagataaaaccaaaaaaatatttcatgaacaacctagaacaaataaagcttttatataataaatatataaataaataaaggctatggaataatatacttcaatatatttggattaaataaattgttggcggggttgatatatttatacacacctaaagtcacttcaatctcattttcacttaacttttattttttttttctttttatttatcataaagagaatattgataatatactttttaacatatttttatgacattttttattggtgaaaacttattaaaaatcataaattttgtaagttagatttatttaaagagttcctcttcttattttaaattttttaataaatttttaaataactaaaatttgtgttaaaaatgttaaaaaatgtgttattaacccttctcttcgaggacgtacgtctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgagctcggtacccggggatcct

SEQ ID NO: 342 - DNA, 9036 bp, Artificial Sequence
  plasmid pKR1266
  misc_feature (4081)..(4081): n is a, c, g, or t
ggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatcctgcaggtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcggtacctaattaactaggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgactaagatctcgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattttaaacgcgtgtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaacttaagaattcggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacgacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgactaattaatcacaattcttaagttttggagtcacgtaaaagccaatcacgacgcataccattcttccctgatccagaaacccaagtgtccacttgaactatgtcaccccatgtaggatagcgttccaccacaacctgcatccgagtaaccacccatatcaagttctttttgcacatttctggcgtggaaccaaagccatcaccaagaagcccagcacttttaacatgattaagtgcagtttcttgcaaatggttcattactgtttctatagatgcggtacgatcagcaccaatctcatatgatctaatagaaaagttttcacggaacacaagaccatcctgaacaatttttcctatcccaaaggggtcaataagcatgtcaggtcgccgtggcttccaatcaagcatcatccactgcttttcagcggccaagaaaattgttgtgatagcagcaagaagcatgctccaatcaggcaactggttgataaaagttctggggggaggcgaaggtagatcatcatcatgcttgaagctttctttagatgtaacaactgtggttccattaattttcgaaggggcttgcgcctttgccttcaagccaccagaagacgcagatttggattttagtcctccaaggtttgcaggcccaccaccaagtttgctgcctgctccaccagagtccggcgagggtgaagtaacagggaaaaatgatgaagtagcagctgttgccacacgcgtttaaaatattggcttgattgcattggttgcctccattgcatggtaatgtggcattgtagagaagagatggtgagccacatgagtatcagttatgtgatgaaacaccttgttcagaatcccataatctctgtccatagttgccaaagctcccttcagccagtcccattctgatgaatcgtaatgaggcaaggcaaagtgtgtgtgctgcaaatatgtgatagtcacaagaaaaccgttcacaatgagcaaaggcaccccataaacacatagcagccaaaccaaccctttcagggttgcaacacggtagagagagtaagtcacagaaaacaaagcaacatcagagacatagatcagaagcctctcacggttagaatatatgggagcataagggtggtagtggcttgcaaaactatcatagggtctaccagagacattgaaggctaaatacataggccaccctattgtgagtgtgacgagaagagaaacagcccttcctagagggttgtttaagtacttggaaaaccatgcaactttggattttggttttgggacaaacacttcatcacgagatcttagtcaagggaacctgtgttggagtgatggcggcgatggcttattttccatgagaaataagggactaaaagtgttgagtgaagggtcaaacccacaacatcatcaacccattggtacttgctgaaggcatggtgaccacactcgtgagcaatcacccacacaccagtgagaaggcaaccttggagaacccaatagattggccatgcaatgagggaaaagggttgaggaaggaggtggaagtaggtggtggcaatgtagaaaatgaaggcaaatgaaaggtcataaacaacataggagaatgaagtgaggagggagcgctgaaagcagtgtggtggaattgctttcttgagttggccaacagtgaatggtggctttgtgtttggaacccttgagagaggcttcttcccttgaacttccactttggccacacgacctctacctcccattgttgtttcctttgctagacctagttaattaggtaccgc

SEQ ID NO: 343 - DNA, 11615 bp, Artificial Sequence
  plasmid pKR1267
  misc_feature (6454)..(6454): n is a, c, g, or t
ggagatccaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcggtacctaattaactaggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgactaagatctcgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattttaaacgcgtgtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaacttaagaattcggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacgacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgactaattaatcacaattcttaagttttggagtcacgtaaaagccaatcacgacgcataccattcttccctgatccagaaacccaagtgtccacttgaactatgtcaccccatgtaggatagcgttccaccacaacctgcatccgagtaaccacccatatcaagttctttttgcacatttctggcgtggaaccaaagccatcaccaagaagcccagcacttttaacatgattaagtgcagtttcttgcaaatggttcattactgtttctatagatgcggtacgatcagcaccaatctcatatgatctaatagaaaagttttcacggaacacaagaccatcctgaacaatttttcctatcccaaaggggtcaataagcatgtcaggtcgccgtggcttccaatcaagcatcatccactgcttttcagcggccaagaaaattgttgtgatagcagcaagaagcatgctccaatcaggcaactggttgataaaagttctggggggaggcgaaggtagatcatcatcatgcttgaagctttctttagatgtaacaactgtggttccattaattttcgaaggggcttgcgcctttgccttcaagccaccagaagacgcagatttggattttagtcctccaaggtttgcaggcccaccaccaagtttgctgcctgctccaccagagtccggcgagggtgaagtaacagggaaaaatgatgaagtagcagctgttgccacacgcgtttaaaatattggcttgattgcattggttgcctccattgcatggtaatgtggcattgtagagaagagatggtgagccacatgagtatcagttatgtgatgaaacaccttgttcagaatcccataatctctgtccatagttgccaaagctcccttcagccagtcccattctgatgaatcgtaatgaggcaaggcaaagtgtgtgtgctgcaaatatgtgatagtcacaagaaaaccgttcacaatgagcaaaggcaccccataaacacatagcagccaaaccaaccctttcagggttgcaacacggtagagagagtaagtcacagaaaacaaagcaacatcagagacatagatcagaagcctctcacggttagaatatatgggagcataagggtggtagtggcttgcaaaactatcatagggtctaccagagacattgaaggctaaatacataggccaccctattgtgagtgtgacgagaagagaaacagcccttcctagagggttgtttaagtacttggaaaaccatgcaactttggattttggttttgggacaaacacttcatcacgagatcttagtcaagggaacctgtgttggagtgatggcggcgatggcttattttccatgagaaataagggactaaaagtgttgagtgaagggtcaaacccacaacatcatcaacccattggtacttgctgaaggcatggtgaccacactcgtgagcaatcacccacacaccagtgagaaggcaaccttggagaacccaatagattggccatgcaatgagggaaaagggttgaggaaggaggtggaagtaggtggtggcaatgtagaaaatgaaggcaaatgaaaggtcataaacaacataggagaatgaagtgaggagggagcgctgaaagcagtgtggtggaattgctttcttgagttggccaacagtgaatggtggctttgtgtttggaacccttgagagaggcttcttcccttgaacttccactttggccacacgacctctacctcccattgttgtttcctttgctagacctagttaattaggtaccgcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatcctgca

SEQ ID NO: 344 - DNA, 5252 bp, Artificial Sequence
  plasmid pKR457
  misc_feature (3872)..(3872): n is a, c, g, or t
gtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgc

SEQ ID NO: 345 - DNA, 9295 bp, Artificial Sequence
  plasmid pKR1264
  misc_feature (4340)..(4340): n is a, c, g, or t
ggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtgggcggatcccccgggctgcaggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcggtacctaattaactaggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgactaagatctcgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattttaaacgcgtgtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaacttaagaattcggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacgacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgactaattaatcacaattcttaagttttggagtcacgtaaaagccaatcacgacgcataccattcttccctgatccagaaacccaagtgtccacttgaactatgtcaccccatgtaggatagcgttccaccacaacctgcatccgagtaaccacccatatcaagttctttttgcacatttctggcgtggaaccaaagccatcaccaagaagcccagcacttttaacatgattaagtgcagtttcttgcaaatggttcattactgtttctatagatgcggtacgatcagcaccaatctcatatgatctaatagaaaagttttcacggaacacaagaccatcctgaacaatttttcctatcccaaaggggtcaataagcatgtcaggtcgccgtggcttccaatcaagcatcatccactgcttttcagcggccaagaaaattgttgtgatagcagcaagaagcatgctccaatcaggcaactggttgataaaagttctggggggaggcgaaggtagatcatcatcatgcttgaagctttctttagatgtaacaactgtggttccattaattttcgaaggggcttgcgcctttgccttcaagccaccagaagacgcagatttggattttagtcctccaaggtttgcaggcccaccaccaagtttgctgcctgctccaccagagtccggcgagggtgaagtaacagggaaaaatgatgaagtagcagctgttgccacacgcgtttaaaatattggcttgattgcattggttgcctccattgcatggtaatgtggcattgtagagaagagatggtgagccacatgagtatcagttatgtgatgaaacaccttgttcagaatcccataatctctgtccatagttgccaaagctcccttcagccagtcccattctgatgaatcgtaatgaggcaaggcaaagtgtgtgtgctgcaaatatgtgatagtcacaagaaaaccgttcacaatgagcaaaggcaccccataaacacatagcagccaaaccaaccctttcagggttgcaacacggtagagagagtaagtcacagaaaacaaagcaacatcagagacatagatcagaagcctctcacggttagaatatatgggagcataagggtggtagtggcttgcaaaactatcatagggtctaccagagacattgaaggctaaatacataggccaccctattgtgagtgtgacgagaagagaaacagcccttcctagagggttgtttaagtacttggaaaaccatgcaactttggattttggttttgggacaaacacttcatcacgagatcttagtcaagggaacctgtgttggagtgatggcggcgatggcttattttccatgagaaataagggactaaaagtgttgagtgaagggtcaaacccacaacatcatcaacccattggtacttgctgaaggcatggtgaccacactcgtgagcaatcacccacacaccagtgagaaggcaaccttggagaacccaatagattggccatgcaatgagggaaaagggttgaggaaggaggtggaagtaggtggtggcaatgtagaaaatgaaggcaaatgaaaggtcataaacaacataggagaatgaagtgaggagggagcgctgaaagcagtgtggtggaattgctttcttgagttggccaacagtgaatggtggctttgtgtttggaacccttgagagaggcttcttcccttgaacttccactttggccacacgacctctacctcccattgttgtttcctttgctagacctagttaattaggtaccgc

SEQ ID NO: 346 - DNA, 2577 bp, Artificial Sequence
  plasmid pKR277
agcttggatctcctgcaggatctggccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgcca

SEQ ID NO: 347 - DNA, 9219 bp, Artificial Sequence
  plasmid pKR1269
  misc_feature (3769)..(3769): n is a, c, g, or t
ggatctggccggccggatctcgtacggatccgtcgacggcgcgcccgatcatccggatatagttcctcctttcagcaaaaaacccctcaagacccgtttagaggccccaaggggttatgctagttattgctcagcggtggcagcagccaactcagcttcctttcgggctttgttagcagccggatcgatccaagctgtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggcttttccatgggtatatctccttcttaaagttaaacaaaattatttctagagggaaaccgttgtggtctccctatagtgagtcgtattaatttcgcgggatcgagatctgatcaacctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatggacatattgtcgttagaacgcggctacaattaatacataaccttatgtatcatacacatacgatttaggtgacactatagaacggcgcgccaagcttggatctcctgcaggtcgactcgacgtacgtcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagntaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagcggccgcggtacctaattaactaggtctagcaaaggaaacaacaatgggaggtagaggtcgtgtggccaaagtggaagttcaagggaagaagcctctctcaagggttccaaacacaaagccaccattcactgttggccaactcaagaaagcaattccaccacactgctttcagcgctccctcctcacttcattctcctatgttgtttatgacctttcatttgccttcattttctacattgccaccacctacttccacctccttcctcaacccttttccctcattgcatggccaatctattgggttctccaaggttgccttctcactggtgtgtgggtgattgctcacgagtgtggtcaccatgccttcagcaagtaccaatgggttgatgatgttgtgggtttgacccttcactcaacacttttagtcccttatttctcatggaaaataagccatcgccgccatcactccaacacaggttcccttgactaagatctcgtgatgaagtgtttgtcccaaaaccaaaatccaaagttgcatggttttccaagtacttaaacaaccctctaggaagggctgtttctcttctcgtcacactcacaatagggtggcctatgtatttagccttcaatgtctctggtagaccctatgatagttttgcaagccactaccacccttatgctcccatatattctaaccgtgagaggcttctgatctatgtctctgatgttgctttgttttctgtgacttactctctctaccgtgttgcaaccctgaaagggttggtttggctgctatgtgtttatggggtgcctttgctcattgtgaacggttttcttgtgactatcacatatttgcagcacacacactttgccttgcctcattacgattcatcagaatgggactggctgaagggagctttggcaactatggacagagattatgggattctgaacaaggtgtttcatcacataactgatactcatgtggctcaccatctcttctctacaatgccacattaccatgcaatggaggcaaccaatgcaatcaagccaatattttaaacgcgtgtggcaacagctgctacttcatcatttttccctgttacttcaccctcgccggactctggtggagcaggcagcaaacttggtggtgggcctgcaaaccttggaggactaaaatccaaatctgcgtcttctggtggcttgaaggcaaaggcgcaagccccttcgaaaattaatggaaccacagttgttacatctaaagaaagcttcaagcatgatgatgatctaccttcgcctccccccagaacttttatcaaccagttgcctgattggagcatgcttcttgctgctatcacaacaattttcttggccgctgaaaagcagtggatgatgcttgattggaagccacggcgacctgacatgcttattgacccctttgggataggaaaaattgttcaggatggtcttgtgttccgtgaaaacttttctattagatcatatgagattggtgctgatcgtaccgcatctatagaaacagtaatgaaccatttgcaagaaactgcacttaatcatgttaaaagtgctgggcttcttggtgatggctttggttccacgccagaaatgtgcaaaaagaacttgatatgggtggttactcggatgcaggttgtggtggaacgctatcctacatggggtgacatagttcaagtggacacttgggtttctggatcagggaagaatggtatgcgtcgtgattggcttttacgtgactccaaaacttaagaattcggtgaaatcttgacaagagcttccagtgtttgggtcatgatgaataagctaacacggaggctgtctaaaattccagaagaagtcagacaggagataggatcttattttgtggattctgatccaattctggaagaggataacagaaaactgactaaacttgacgacgacacagcggattatattcgtaccggtttaagtcctaggtggagtgatctagatatcaatcagcatgtcaacaatgtgaagtacattggctggattctggagagtgctccacagccaatcttggagagtcatgagctttcttccatgactttagagtataggagagagtgtggtagggacagtgtgctggattccctgactgctgtatctggggccgacatgggcaatctagctcacagcgggcatgttgagtgcaagcatttgcttcgactggaaaatggtgctgagattgtgactaattaatcacaattcttaagttttggagtcacgtaaaagccaatcacgacgcataccattcttccctgatccagaaacccaagtgtccacttgaactatgtcaccccatgtaggatagcgttccaccacaacctgcatccgagtaaccacccatatcaagttctttttgcacatttctggcgtggaaccaaagccatcaccaagaagcccagcacttttaacatgattaagtgcagtttcttgcaaatggttcattactgtttctatagatgcggtacgatcagcaccaatctcatatgatctaatagaaaagttttcacggaacacaagaccatcctgaacaatttttcctatcccaaaggggtcaataagcatgtcaggtcgccgtggcttccaatcaagcatcatccactgcttttcagcggccaagaaaattgttgtgatagcagcaagaagcatgctccaatcaggcaactggttgataaaagttctggggggaggcgaaggtagatcatcatcatgcttgaagctttctttagatgtaacaactgtggttccattaattttcgaaggggcttgcgcctttgccttcaagccaccagaagacgcagatttggattttagtcctccaaggtttgcaggcccaccaccaagtttgctgcctgctccaccagagtccggcgagggtgaagtaacagggaaaaatgatgaagtagcagctgttgccacacgcgtttaaaatattggcttgattgcattggttgcctccattgcatggtaatgtggcattgtagagaagagatggtgagccacatgagtatcagttatgtgatgaaacaccttgttcagaatcccataatctctgtccatagttgccaaagctcccttcagccagtcccattctgatgaatcgtaatgaggcaaggcaaagtgtgtgtgctgcaaatatgtgatagtcacaagaaaaccgttcacaatgagcaaaggcaccccataaacacatagcagccaaaccaaccctttcagggttgcaacacggtagagagagtaagtcacagaaaacaaagcaacatcagagacatagatcagaagcctctcacggttagaatatatgggagcataagggtggtagtggcttgcaaaactatcatagggtctaccagagacattgaaggctaaatacataggccaccctattgtgagtgtgacgagaagagaaacagcccttcctagagggttgtttaagtacttggaaaaccatgcaactttggattttggttttgggacaaacacttcatcacgagatcttagtcaagggaacctgtgttggagtgatggcggcgatggcttattttccatgagaaataagggactaaaagtgttgagtgaagggtcaaacccacaacatcatcaacccattggtacttgctgaaggcatggtgaccacactcgtgagcaatcacccacacaccagtgagaaggcaaccttggagaacccaatagattggccatgcaatgagggaaaagggttgaggaaggaggtggaagtaggtggtggcaatgtagaaaatgaaggcaaatgaaaggtcataaacaacataggagaatgaagtgaggagggagcgctgaaagcagtgtggtggaattgctttcttgagttggccaacagtgaatggtggctttgtgtttggaacccttgagagaggcttcttcccttgaacttccactttggccacacgacctctacctcccattgttgtttcctttgctagacctagttaattaggtaccgcggccgcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgtacgtgggcggatcccccgggctgca

SEQ ID NO: 348 - DNA, 39 bp, Artificial Sequence
  primer CC ORF FWD
gcggccgcaccatgatggcagaggtcctatcggtatccg

SEQ ID NO: 349 - DNA, 37 bp, Artificial Sequence
  primer CC ORF REV
gcggccgcctactcgacaatgctgagctcccgcgacc

SEQ ID NO: 350 - DNA, 1506 bp, Cryptococcus curvatus
atgatggcagaggtcctatcggtatccgcgtcggcgtcgcccagctccagcatctccagcacgacctcaaccgaacccaccaccgacattggcgagggcagtctggggctgtcacctggcccagcgggcctccgcctacggttcccacgcaacggtgggagcctaacccaccattcctcagactacggcaaggacctgtcaccggccccgtcgctgctcaccctgcactcggcgcccgactccccagacgccaactctccagcctcggagcggagcgacctctactctgactatgacctgcccgatcccgacacggggcctgccgtgcccgtcgcccgtaggaaaaggagtgccagcgatgggccgactcccgggtcgctcatgcttacggcgctggacgagaagccggtgaagaccaagagcaagatacagcggttgaagagcaagagcccgttgctggagagtctcaagctcccgccgctcagcgagatcagcattccccgaccagaacagatcaaattcgcacctttgcatatccctcctcaccgccgactgcagaccgcagcagtcgcgacatgggcactgctcatgcccctttgtttcattgcattcctctttgcattatcattcccccgcctatggccagtgctcatcccgtacatgatctggggggtcttcttcgaccaagcgcccgagcacggagggcgtcccaagaagtgggcgcgtcggttcttcatgtggaagtactatgcgcaatattatccatgcagcatcgtaaaggaagccgatctcccagccagcaacaaatacgtcttcggctaccacccacatgggattataggcatgggagctgtcgcggcctttgcgtccgaggcgacagggttctccgactacttccccggaatcaggccgcacctcctcaccctagacacaaacttcaacatccccttctaccgcgagatactcatgtggctgggcatctgctcggtctccaaggcgtcgtgcaggaacatcctggccaagggtccgggctatgccatcaccattgtcgtgggcggcgcggccgagtccctcgcagcccacccgggcacgcaggatctcacgctgaagaagcgctttggctttgtaaaggtcgcaatcagggagggcgcacagcttgtgcccgtgttttcctttggcgagaatgacatttacgaccagcttgcaaacgagaagggctcaacagtgtacaagctgcagaagacgttccaaaagatcttcgggttcaccctcccgctcttccacgggcgcgggctcttcaactacaactacgggctcatgcccttccgccaccccatcgtcactgtcgtcggccgccccgtcacggtgaagcagaacctcaacccccaggacgaggaggtgcaagaagtgcaccgccgctacatcgaggagctggtgcgcgtctgggacaagtacaaggatatatatgccaagaacaggtcgcgggagctcagcattgtcgagtag

SEQ ID NO: 351 - protein, 501 aa, Cryptococcus curvatus
MMAEVLSVSASASPSSSISSTTSTEPTTDIGEGSLGLSPGPAGLRLRFPRNGGSLTHHSSDYGKDLSPAPSLLTLHSAPDSPDANSPASERSDLYSDYDLPDPDTGPAVPVARRKRSASDGPTPGSLMLTALDEKPVKTKSKIQRLKSKSPLLESLKLPPLSEISIPRPEQIKFAPLHIPPHRRLQTAAVATWALLMPLCFIAFLFALSFPRLWPVLIPYMIWGVFFDQAPEHGGRPKKWARRFFMWKYYAQYYPCSIVKEADLPASNKYVFGYHPHGIIGMGAVAAFASEATGFSDYFPGIRPHLLTLDTNFNIPFYREILMWLGICSVSKASCRNILAKGPGYAITIVVGGAAESLAAHPGTQDLTLKKRFGFVKVAIREGAQLVPVFSFGENDIYDQLANEKGSTVYKLQKTFQKIFGFTLPLFHGRGLFNYNYGLMPFRHPIVTVVGRPVTVKQNLNPQDEEVQEVHRRYIEELVRVWDKYKDIYAKNRSRELSIVE

SEQ ID NO: 352 - DNA, 34 bp, Artificial Sequence
  primer CzDGAT2-5
agcggccgcaccatggaaaacgacgcggcccacc

SEQ ID NO: 353 - DNA, 31 bp, Artificial Sequence
  primer CzDGAT2-3
agcggccgctcactcgacaatgttcaacttg

SEQ ID NO: 354 - DNA, 5227 bp, Artificial Sequence
  plasmid pHD39
cctgaattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcagggcggccgcaccatggaaaacgacgcggcccacctcaccagaaggaagcccaaacacccactggcgggcgccgacagcacgcaccgcgacgccgatcggcggcccaccaccccaaccagatcgccgccgctggcgcggctcaagctccacatcgcgccgatcaacacccccatgaagcaccagttgcaaacgttggggttgatctggcacaccatcctgattcccttcttcatgtttgtgtttctcttcaccctctacttggggtgggtggcgtggttgatgatgatcttgccctacttcatctggtggtacggcttcgacttgcacacgcccgccaacggcaagacgcagtaccgctacaaggactgggtgcgcaacctcattgtgtgggagtggtttgtggactacttcccgatcagggtgcacaaggcgtgcgagttggaacccaccttcctgcacgtgctcgttgaggagacgctggcgcagcccgacgacgaagaggacctagtgctggagaactcgcgcaccttgctcgataccgtgttcaagcggttggggttgcagaagcgcatcaacgtcattgacgggtacctgccgccggcctccggcggccgcaaaaagcacaaaaaggtgctgacgggcccgcgctacatctttggctaccacccgcacggcgtcatttcgatgggggtgatgggcacctttggcaccaacgccatccgcaacgagccctttgagccgccgctcaagtttttgaagccgttgttccacgacccctcgggcaaagagcgtcttttgcccgacattgagaagatcttcccctcgacgttgagcacgcagttcacgctcccgttctaccgcgactacctcctcagcctcggcttgacgagcgccgcggcaaagaacatcaagagcttgattcagaacggcgacaactccatcgtgttggtggtgggtggggcacaggagtctcttttgaacgacgtggtggcgtcgcacgcgcacgtgggcaacggttacacggggccacgtcaaaaggaggatccacagcagcatcagcagcagcagctgctgctgctgctgctgccgctgctggacacctcgggccctccgcaatccagagaaatccgtctcgtgttgaacaaacgcaagggcttcgtcaaaattgccatcgagctcggcaacatcagcttggtgccgatctttgcgtttggagaggccgacatctacaacgtcaacatccccgacaagggcacgtggggcgagcaatttcagctatggatgaaaaaggtgttcagcttcacgctcccctttttcagtgctcgcggcgtgttcatctacgactttggctttttgccctaccgccacccgatcaacttgtgcatggggcgacccattcacatccctgcaggtacgttgcaggagtacaagttgaagcacccggactgggacgagtccggcgacaagcctgcggcaacgcacctcgacgcggtcaagcacacctcgagcagaagcaactcgttctctaacttgttcaagttgaatcaaaagagcgccgcccccaagcccacgccgtccaaaacgattgtgccccccaaattgctagaccactaccaccggctttacatggatgagttaaagcgcgtctacgaggataacaaggacaagtttggctacagcgatgtcaagttgaacattgtcgagtgagcggccgct

SEQ ID NO: 355 - DNA, 8791 bp, Artificial Sequence
  plasmid pKR1392
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaaaacgacgcggcccacctcaccagaaggaagcccaaacacccactggcgggcgccgacagcacgcaccgcgacgccgatcggcggcccaccaccccaaccagatcgccgccgctggcgcggctcaagctccacatcgcgccgatcaacacccccatgaagcaccagttgcaaacgttggggttgatctggcacaccatcctgattcccttcttcatgtttgtgtttctcttcaccctctacttggggtgggtggcgtggttgatgatgatcttgccctacttcatctggtggtacggcttcgacttgcacacgcccgccaacggcaagacgcagtaccgctacaaggactgggtgcgcaacctcattgtgtgggagtggtttgtggactacttcccgatcagggtgcacaaggcgtgcgagttggaacccaccttcctgcacgtgctcgttgaggagacgctggcgcagcccgacgacgaagaggacctagtgctggagaactcgcgcaccttgctcgataccgtgttcaagcggttggggttgcagaagcgcatcaacgtcattgacgggtacctgccgccggcctccggcggccgcaaaaagcacaaaaaggtgctgacgggcccgcgctacatctttggctaccacccgcacggcgtcatttcgatgggggtgatgggcacctttggcaccaacgccatccgcaacgagccctttgagccgccgctcaagtttttgaagccgttgttccacgacccctcgggcaaagagcgtcttttgcccgacattgagaagatcttcccctcgacgttgagcacgcagttcacgctcccgttctaccgcgactacctcctcagcctcggcttgacgagcgccgcggcaaagaacatcaagagcttgattcagaacggcgacaactccatcgtgttggtggtgggtggggcacaggagtctcttttgaacgacgtggtggcgtcgcacgcgcacgtgggcaacggttacacggggccacgtcaaaaggaggatccacagcagcatcagcagcagcagctgctgctgctgctgctgccgctgctggacacctcgggccctccgcaatccagagaaatccgtctcgtgttgaacaaacgcaagggcttcgtcaaaattgccatcgagctcggcaacatcagcttggtgccgatctttgcgtttggagaggccgacatctacaacgtcaacatccccgacaagggcacgtggggcgagcaatttcagctatggatgaaaaaggtgttcagcttcacgctcccctttttcagtgctcgcggcgtgttcatctacgactttggctttttgccctaccgccacccgatcaacttgtgcatggggcgacccattcacatccctgcaggtacgttgcaggagtacaagttgaagcacccggactgggacgagtccggcgacaagcctgcggcaacgcacctcgacgcggtcaagcacacctcgagcagaagcaactcgttctctaacttgttcaagttgaatcaaaagagcgccgcccccaagcccacgccgtccaaaacgattgtgccccccaaattgctagaccactaccaccggctttacatggatgagttaaagcgcgtctacgaggataacaaggacaagtttggctacagcgatgtcaagttgaacattgtcgagtgagc

SEQ ID NO: 356 - DNA, 29 bp, Artificial Sequence
  primer oMcDG2-2
agcggccgcaccatgaaagaacctgtcag

SEQ ID NO: 357 - DNA, 25 bp, Artificial Sequence
  primer oMcDG2-2
tgcggccgcctagctaacaatacgc

SEQ ID NO: 358 - DNA, 4643 bp, Artificial Sequence
  plasmid pKR1408
aattccagcacactggcggccgttactagtggatccgagctcggtaccaagcttgatgcatagcttgagtattctaacgcgtcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttagcacgtgtcagtcctgctcctcggccacgaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatggtggccctcctcacgtgctattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggccctctagatgcatgctcgagcggccgccagtgtgatggatatctgcagaattcaggagcggccgcaccatgaaagaacctgtcagcaaggaaaacacagatacaaaatcggacagaaagattgctttgccagacatcaagaaagtatcacaagtcattcccaatgtgcccgaggtacaatgggcgcctttgacaggtattccgtttgaaagaaggatccagatggccgtcgtcttgatgtggatctttcttttgggcaactgcctaaccctcttttgctgctccctgtttcttccattcctgtggcctttgcacattgcttacatcatctacctttatcgcgatcagtcggcagagaatggcggtcgtcgttcagattggttccgtcgcttgcctatctggaattattatgctggttattttcctgccaaattggtcaaggagcaagatcttgatcccaaaaagaattacgtctttgggtcgcatccacacggcatcatcagtatcagcagttttgctagttttgctacggaagcaacagggttctctcaactgtttcctggtatcattccctctctattgaccttgacaaccaactttaaattccccatctatcgcgatatcattcttgccttgggtattgcttctgtttcgcgtcattcctgtgaaaagattctatcatctggtcctggtcgttcgattgtgattgtcattggaggtgcatctgaatccctgaatgctcgtccaggcatcgcagatctcgtactgaaaaagagattaggtttcatccgaatcgcgattcgtcatggagccgatctagtgcccgtcttttcatttggtgaaaacgaattgtatgaacaagtcgataattcgacaggtagttggctttggaaggcgcagaaaaagatgcaacaggcacttggattcactatgcccttgtttcacgcgcgtggtattttcaattataatgtcggtttgatcccttatagacatcctattgttactgttgttggaaagcctattccagtacctaaaatgaagcctggtcaaacagaacccactcaggagcaattgttggaaacgcaagcattgtatatcgaggagttggagtccatctacaacaagtacaaggatgtgtatgcaaaggatcgaaagcaagatttgcgtattgttagctaggcggccgccctg

SEQ ID NO: 359 - DNA, 1110 bp, Mucor circinelloides
atgaaagaacctgtcagcaaggaaaacacagatacaaaatcggacagaaagattgctttgccagacatcaagaaagtatcacaagtcattcccaatgtgcccgaggtacaatgggcgcctttgacaggtattccgtttgaaagaaggatccagatggccgtcgtcttgatgtggatctttcttttgggcaactgcctaaccctcttttgctgctccctgtttcttccattcctgtggcctttgcacattgcttacatcatctacctttatcgcgatcagtcggcagagaatggcggtcgtcgttcagattggttccgtcgcttgcctatctggaattattatgctggttattttcctgccaaattggtcaaggagcaagatcttgatcccaaaaagaattacgtctttgggtcgcatccacacggcatcatcagtatcagcagttttgctagttttgctacggaagcaacagggttctctcaactgtttcctggtatcattccctctctattgaccttgacaaccaactttaaattccccatctatcgcgatatcattcttgccttgggtattgcttctgtttcgcgtcattcctgtgaaaagattctatcatctggtcctggtcgttcgattgtgattgtcattggaggtgcatctgaatccctgaatgctcgtccaggcatcgcagatctcgtactgaaaaagagattaggtttcatccgaatcgcgattcgtcatggagccgatctagtgcccgtcttttcatttggtgaaaacgaattgtatgaacaagtcgataattcgacaggtagttggctttggaaggcgcagaaaaagatgcaacaggcacttggattcactatgcccttgtttcacgcgcgtggtattttcaattataatgtcggtttgatcccttatagacatcctattgttactgttgttggaaagcctattccagtacctaaaatgaagcctggtcaaacagaacccactcaggagcaattgttggaaacgcaagcattgtatatcgaggagttggagtccatctacaacaagtacaaggatgtgtatgcaaaggatcgaaagcaagatttgcgtattgttagctag

SEQ ID NO: 360 - DNA, 8206 bp, Artificial Sequence
  plasmid pKR1409
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgaaagaacctgtcagcaaggaaaacacagatacaaaatcggacagaaagattgctttgccagacatcaagaaagtatcacaagtcattcccaatgtgcccgaggtacaatgggcgcctttgacaggtattccgtttgaaagaaggatccagatggccgtcgtcttgatgtggatctttcttttgggcaactgcctaaccctcttttgctgctccctgtttcttccattcctgtggcctttgcacattgcttacatcatctacctttatcgcgatcagtcggcagagaatggcggtcgtcgttcagattggttccgtcgcttgcctatctggaattattatgctggttattttcctgccaaattggtcaaggagcaagatcttgatcccaaaaagaattacgtctttgggtcgcatccacacggcatcatcagtatcagcagttttgctagttttgctacggaagcaacagggttctctcaactgtttcctggtatcattccctctctattgaccttgacaaccaactttaaattccccatctatcgcgatatcattcttgccttgggtattgcttctgtttcgcgtcattcctgtgaaaagattctatcatctggtcctggtcgttcgattgtgattgtcattggaggtgcatctgaatccctgaatgctcgtccaggcatcgcagatctcgtactgaaaaagagattaggtttcatccgaatcgcgattcgtcatggagccgatctagtgcccgtcttttcatttggtgaaaacgaattgtatgaacaagtcgataattcgacaggtagttggctttggaaggcgcagaaaaagatgcaacaggcacttggattcactatgcccttgtttcacgcgcgtggtattttcaattataatgtcggtttgatcccttatagacatcctattgttactgttgttggaaagcctattccagtacctaaaatgaagcctggtcaaacagaacccactcaggagcaattgttggaaacgcaagcattgtatatcgaggagttggagtccatctacaacaagtacaaggatgtgtatgcaaaggatcgaaagcaagatttgcgtattgttagctaggc

SEQ ID NO: 361 - DNA, 8602 bp, Artificial Sequence
  plasmid  pKR1427
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgatggcagaggtcctatcggtatccgcgtcggcgtcgcccagctccagcatctccagcacgacctcaaccgaacccaccaccgacattggcgagggcagtctggggctgtcacctggcccagcgggcctccgcctacggttcccacgcaacggtgggagcctaacccaccattcctcagactacggcaaggacctgtcaccggccccgtcgctgctcaccctgcactcggcgcccgactccccagacgccaactctccagcctcggagcggagcgacctctactctgactatgacctgcccgatcccgacacggggcctgccgtgcccgtcgcccgtaggaaaaggagtgccagcgatgggccgactcccgggtcgctcatgcttacggcgctggacgagaagccggtgaagaccaagagcaagatacagcggttgaagagcaagagcccgttgctggagagtctcaagctcccgccgctcagcgagatcagcattccccgaccagaacagatcaaattcgcacctttgcatatccctcctcaccgccgactgcagaccgcagcagtcgcgacatgggcactgctcatgcccctttgtttcattgcattcctctttgcattatcattcccccgcctatggccagtgctcatcccgtacatgatctggggggtcttcttcgaccaagcgcccgagcacggagggcgtcccaagaagtgggcgcgtcggttcttcatgtggaagtactatgcgcaatattatccatgcagcatcgtaaaggaagccgatctcccagccagcaacaaatacgtcttcggctaccacccacatgggattataggcatgggagctgtcgcggcctttgcgtccgaggcgacagggttctccgactacttccccggaatcaggccgcacctcctcaccctagacacaaacttcaacatccccttctaccgcgagatactcatgtggctgggcatctgctcggtctccaaggcgtcgtgcaggaacatcctggccaagggtccgggctatgccatcaccattgtcgtgggcggcgcggccgagtccctcgcagcccacccgggcacgcaggatctcacgctgaagaagcgctttggctttgtaaaggtcgcaatcagggagggcgcacagcttgtgcccgtgttttcctttggcgagaatgacatttacgaccagcttgcaaacgagaagggctcaacagtgtacaagctgcagaagacgttccaaaagatcttcgggttcaccctcccgctcttccacgggcgcgggctcttcaactacaactacgggctcatgcccttccgccaccccatcgtcactgtcgtcggccgccccgtcacggtgaagcagaacctcaacccccaggacgaggaggtgcaagaagtgcaccgccgctacatcgaggagctggtgcgcgtctgggacaagtacaaggatatatatgccaagaacaggtcgcgggagctcagcattgtcgagtaggc

SEQ ID NO: 362 - DNA, 1506 bp, Cryptococcus curvatus
atgatggccgaggttctctccgtttccgcctccgcttctccctcttcctccatctcctccaccacctccaccgagcccacaacagacattggcgagggttctcttggtctttccccaggtccagccggtctcagacttagattccctaggaatggaggctcccttacccaccattcctccgactacggtaaggacctttctcccgctccatctcttctcacactccactccgctcccgactccccagatgccaattctcccgcttccgagcgctccgacctttactccgactacgacctccccgatccagatactggtccagccgttccagttgctcgtcgcaagagatctgcctccgatggtccaacaccaggctctctcatgcttaccgcactcgacgagaagcccgtgaagacaaagtccaagatccagcgcctcaagtccaagtccccactccttgagtcccttaagctcccacccctctccgagatttccattcccagacccgagcagatcaagttcgctcccctccacatccctccacatagacgccttcagaccgctgccgttgctacctgggctcttcttatgccactctgcttcatcgccttcctcttcgccctctccttccccagactctggcctgttctcattccctacatgatctggggtgtgttcttcgaccaggcaccagagcatggtggtagacccaagaagtgggctcgtcgcttcttcatgtggaagtactacgcccagtactacccatgctccatcgtgaaggaggccgatctcccagcctccaataagtatgtgttcggctaccatccacacggcatcatcggtatgggtgccgttgctgctttcgcttctgaggccaccggtttctccgactacttcccaggtattcgcccacatcttctcaccctcgacaccaacttcaacatccccttcttccgcgagatcctcatgtggctcggtatctgctccgtgtccaaggcctcctgcagaaacattctcgccaagggtcctggctacgccattaccatcgttgttggtggtgctgctgagtctcttgccgctcacccaggtacccaggatctcacccttaagaagcgcttcggcttcgttaaggtggccatcagagagggagctcagcttgttccagtgttctccttcggcgagaacgacatctacgaccagctcgccaatgagaagggctccacagtgtacaagctccagaagaccttccagaagatcttcggtttcacactcccactcttccacggtcgtggcctcttcaactacaactacggcctcatgcccttccgccacccaattgtgacagttgtgggcagacccgtgaccgttaagcagaacctcaacccacaggacgaggaggtacaggaggttcaccgcagatacatcgaggagctcgttagagtgtgggataagtacaaggacatctacgccaagaatcgctctcgcgagctctccatcgttgagtag

SEQ ID NO: 363 - protein, 501 aa, Cryptococcus curvatus
MMAEVLSVSASASPSSSISSTTSTEPTTDIGEGSLGLSPGPAGLRLRFPRNGGSLTHHSSDYGKDLSPAPSLLTLHSAPDSPDANSPASERSDLYSDYDLPDPDTGPAVPVARRKRSASDGPTPGSLMLTALDEKPVKTKSKIQRLKSKSPLLESLKLPPLSEISIPRPEQIKFAPLHIPPHRRLQTAAVATWALLMPLCFIAFLFALSFPRLWPVLIPYMIWGVFFDQAPEHGGRPKKWARRFFMWKYYAQYYPCSIVKEADLPASNKYVFGYHPHGIIGMGAVAAFASEATGFSDYFPGIRPHLLTLDTNFNIPFFREILMWLGICSVSKASCRNILAKGPGYAITIVVGGAAESLAAHPGTQDLTLKKRFGFVKVAIREGAQLVPVFSFGENDIYDQLANEKGSTVYKLQKTFQKIFGFTLPLFHGRGLFNYNYGLMPFRHPIVTVVGRPVTVKQNLNPQDEEVQEVHRRYIEELVRVWDKYKDIYAKNRSRELSIVE

SEQ ID NO: 364 - DNA, 8458 bp, Artificial Sequence
  plasmid pKR1422
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgagagacaccgagttcgagcagaagctccgccagagaacacgcgtggatagaacagagcccaccaagccagtttctggttctaccacacccgatacctctcttccagaggacgacgacaaggccaaggctaagggcggcttcttcaattccctccgcgacgagatgtcatcttacagatccgacagaggcagaaagtcttccgacggtcagttcggtgaggagggccttgttccacattacggtcttcccagacttgacgcttgctgctccatccagacaccaatgagacgccgccttcagacagccattgttgcctggcacatttcctccttcgtgttcctcgccgtgctctccatctacgctctctccaatcccatgctctggttcgcctcaatcccctacaccatctacttcatcttcgatagagctcccggtaacggcggtgttgttaagcgcagatctcactggttccgctcccttcccatctggacatggtactgcgagtacttccccatcaatctcgacaagaccgtgccccttacacccacctacaccgagaagaagccctctccatccgagaacaccaagaagtcatccatcttcaaccccaagtcctggaagctcttccgcagatccgagaagtacgagagaaccggtcccagatacatcttcggctaccacccacatggaattggtgcccttggtgctttcggtgccattggtaccgagggttgcggttggtctaagaagttcccaggcatcaacgtgtcactcatgacccttgttgcccagttccacgtgccactcttccgcgattacctcctcgcccttggtatctccgctgttacccgcaagaactccctcaaggttctcgagcgcaaccattccatctgcatcgttgtgggtggcgctagagagtcccttatgtcctccatcggctctgtggatctcgtgcttaagcgccgcaagggtttcatcagactcgctctcgagtccggcaacgtttctctcgttccagtgttcggtttcggcgagaccgattgctacaacatcgtgcacacctccgagaactccttctcccacaaggtgcagctctggatgaagaagaactacggcttcaccatccccatcttctacgccagaggtctcttcaactacgatttcggcttcctcccattccgcacacccatcaccgttctcaccggcaacccaatctacgtggagaagaagattcccaatcccacacaggagcaggtggaccactaccacgacctctacgttgaggagctcaagaagctctactacgacaaccgccacaagtacggctacggtacagtggagatgcagatcgctggctaggc

SEQ ID NO: 365 - DNA, 8386 bp, Artificial Sequence
  plasmid pKR1421
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgatgcccgccaaggatcttctcgagtccaacgagctttcccagatttccgacgaggacgagttcccatccaagaatcccgacaacgacgcctcttccctcgagaagaacatcgtggttccaaacgatggcagagtgttcaagaaggccgacccaaagagaacacgcggttcatccatcggtaacgttagagtggctccactctccacaccacttccaagacgccttcagacagccgctgtgctctggcataccatctccatccctgtgttcatcaccatcttcttcatctccctcgccatcccaatcttctggctcatcgccgtgccatacctcttctacctcttcacagaccgcaccccctctaacggccaggtgaccaagagatactcagagcgcttcagaaagctctccgtgtggaagtacttctgcaactactaccccgtgaagctcttcaagacccacaacctcgagcccacattcaccgaggtggagatcaaggacgactactaccgccttccaccaccactctcctaccttttcaagatcaacaagaagccctacaagaagctccagaagaccggtcccaagtacatcttcggtctccatccacacggtgttgtgtcactttctggtttcggcggcattggtaccgacggtgccaactggtccaagctcttcccaggtatccccgtttgccttctcacccttcttaaccagttctacatcccactcttccgcgactacctccttgcccttggtatcacatccgctggcaggaacaacgccctcaagatcctcaagcagggtttctctcttgccatcgttgtgggcggtgctcaggagtctcttcttgctagaccagagtccaccgagattgtgcttcagaagcgcaagggcttcatcaagctcgccctcgagacaggcaacgtgtcactcgtgccatgctactgcttcggtgagaacgagctctacaacatcctcgagcccgacgaggattcctactggcgcaagcttcagctctggctcaagaagtccttcggtttcaccattcccttcttccacgccagaggcgtgttcaactacgatttcggcctccttcccttccgcaaggaggttacccttgtgacaggcaagcccatcccagtgccattccttccctcacccaagaagaccgaggtggactactaccacgagctctacgtgaacgagcttcagcgcatcttcgacgagtacaagacaaagttccaagaggacggccagaactccaccctcaagatcgtggagtaggc

SEQ ID NO: 366 - DNA, 9124 bp, Artificial Sequence
  plasmid pKR1420
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgtcccagaactccctcgacgagaagaacaccacctccgacgacaagaagcagcagcttcgccgcagacatggttcccacgataccccctctgagaacggcctccgcaccccctctagatcctccaccaagtccaactccaagcccaagtcacaccgcaagaagtccctcgtgaacttcgctcccctcaacaccccccttcacaacagactcgagactatgggcgtgatttggcactgcctctccatccccttcttcgtgtccctcttcctcctcgccatttccctcggctggatcatctggatcttcgtgatcctcccctacttcatctggtggtacttcttcgacctccacacacccaccaacggcaagacagtgtaccgcgtgaaggactggatgcagaacatcatcgtgtgggagtggttcgtgaactacttccccatctcaatccacaaggcctgcgatcttgagccaaccttcacccagatgctcgtggacgacaacgagggtaacgacgacgaggaggacctcatctccgaggactcccgcaccatcatcgacaagctcttcaagaccctcggcctcagaaagcgcctcaacgactccgactcccacaacgtgctcaacaccccctcctctgacaagaagttcgacaaggccctcaagtataagaaggagtccaccggccctcgctacatcttcggctaccacccacatggcgtgatttctatgggcgtgatgggcgccttcgccaccaacgtgattcgcaacgagccctaccagccacccttctcattcctcaagtccttcttccacgatccctccaagtacacccgcctccttcccggcatcggcaacatcttcccactcaccctcaccacccagttcaccctcccattcttccgcgactaccttatgtccctcggtctcacctccgcctcctacaagaacatcaagtccatcatcaacaacggcgacaactccgtgtgccttgtggttggcggcgctcaggagtcccttctcaacactatggtgtctcccagactccgcatcggcaacggctacaagaacgacgagaccgacgagtctggtgatgagtccgagccaatggtgaaggagtacaaccccaaggaggtggagcactactcaatcaaggagcagatggacgagaacctcgacgagaacaagcacgagtcctccgagtccgactccaacctcgataccgagaagggccaggagaagctcgactctgagaagctcatcaagaccgagaccgacaacgccgaccagcccggcgagaacaaggacaagaacctcaacgaccataacgagaccgagaccgagaagcccggtcagtccgaggagaaggagtcccaggatgacgattcatcctccccacgccagattcagctcgttctcaacaagcgcaagggcttcgtgaagctcgccatcgagctcggcaacgtttgcctcgtgcccacattcggtttcggtgaggctgacatctaccgcattgccaatcccaagcccggctcccttggctccagattccaagagtggatgaagtcaaccttccagttcaccgtgcccttcttctccgcacgcggcgtgttcatctacgacttcggtttccttcccttccgcaaccccatcgacatctgcatgggcgagcccatctacgttccctctggcctcatcgccgattacaagcttaagcatcccggcttcgattccgacgaggaggtggagcagaacaacaagcagaagaaggaggacgagaagggcgacgagacagattccaagaagaaggacaagaaggacttcaagaagaagggcaagaaggacttcaagaccgagaagaaggaggactccaagtccaaggacaagaagcgcgagaagaagatcaagatcccctccgagatcctcaaccactaccacaagctctacgtggacggcctcaagaaggtgtacgaggagaacaagtgtaagttcggctacgaggacgtggagctcatcatcatcgagtaggc

SEQ ID NO: 367 - DNA, 8791 bp, Artificial Sequence
  plasmid pKR1512
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggagaatgacgctgcccaccttaccaggaggaagccaaagcatccacttgccggtgccgattctacccacagagacgctgacagacgcccaacaacaccaacacgctctccaccactcgctcgccttaagctccatatcgctcctatcaacacacccatgaagcaccagctccagacccttggcctcatctggcacaccatcctcatccctttcttcatgttcgtgttcctcttcaccctctaccttggctgggttgcctggcttatgatgatccttccctacttcatctggtggtacggcttcgatctccacacacccgctaacggtaagacccagtaccgctacaaggattgggtgcgcaacctcatcgtttgggagtggttcgtggattacttcccaatccgcgtgcacaaggcttgcgagcttgagccaaccttccttcacgtgcttgtggaggagacacttgcccagccagacgacgaggaggatcttgtgctcgagaattcaagaaccctccttgacaccgtgttcaagcgccttggcctccagaagcgcatcaatgtgatcgacggttaccttccaccagcttctggtggtcgcaagaagcacaagaaggtgcttaccggcccacgctacatcttcggttaccacccacatggcgttatctctatgggcgtgatgggcacattcggcaccaatgctattcgcaacgagcccttcgagccaccactcaagttcctcaagcctctcttccatgatccatcaggtaaggagcgcctcctcccagacattgagaagatcttcccttccaccctctccacacagttcacactcccattcttccgcgactacctcctttcccttggtcttacctctgccgccgctaagaacatcaagtccctgatccagaacggcgacaactccatcgttcttgttgtgggtggtgctcaggagtcacttctcaacgacgttgttgcttctcacgcccacgtgggtaacggctacacaggtccaagacagaaggaggatccacagcagcatcagcagcagcagctccttctcctccttcttccactccttgacacctctggcccaccacagtctagagagatccgccttgttctcaacaagcgcaagggtttcgtgaagatcgccatcgagctcggcaacatctcactcgtgccaatcttcgctttcggcgaggccgacatctacaacgtgaacattcccgacaagggcacatggggtgagcagttccagctctggatgaagaaggtgttctccttcacactcccattcttctctgccagaggcgtgttcatctacgacttcggcttcctcccttacagacatcccatcaatctttgcatgggccgccctattcacattccagctggtacattgcaggagtacaagctcaagcacccagattgggacgagtcaggcgataagcccgctgctacacatctcgatgccgtgaagcacacctcttctagatccaactccttctccaacctcttcaagctcaaccagaagtccgctgctcccaagcccacaccctctaagacaatcgtgccacccaagcttctcgaccactaccatcgcctttacatggacgagctcaagcgcgtgtacgaggataacaaggacaagttcggctactccgacgttaagctcaacatcgtggagtaggc

SEQ ID NO: 368 - DNA, 8329 bp, Artificial Sequence
  plasmid pKR1415
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgtccgagaaggccgagattgaggttcccccacagaagtccaccttcccaagatccgttcatttcgctccactccacatcccactcgagcgcagacttcagacactcgctgtgctcttccacacagttgctcttccctactgcattggcctcttcttccttatgcttgccttcccacccttctggccactcctcgtgatgtacgtgatctacgcctacggtttcgatcactcatcctccaatggtgagatttcccgccgcagatctccactcttcagaagactcccactcttccgcctctactgcgactacttccccatccacatccacagagaggttccacttgagccaacattccccggcagacttagagagccatcaggtcttgtggagagatggatcgccaagatgttcggcgttcaagacgctgtggttgagggtaacgagtctgatgtgaaggctaccgccaatggtaacggcaccaccaaggagatcggtccaacctacgttttcggctaccacccacacggtatcgtttcccttggtgccttcggcgctattggtacagagggtgctggttgggagaagcttttcccaggtattcccgtttcactcctcacactcgagacaaacttctcccttcccttcttccgcgagtaccttctctcccttggtatcgcttccgtgtcccgccgctcttgcacaaacctccttaagcacgatcagtccatctgcatcgtgattggcggcgctcaggagtctcttcttgctgagcccggtacactcgatcttatcctcgtgaagcgccgcggtttcgttaagcttgccatgtcaaccgctcgcgtttctgaccagcccatctgccttgttcccatcctctccttcggcgagaatgatgtgtacgatcaggttcgcggcgacagatcatccaagctctacaagatccagaccttcatcaagaaggccgccggtttcacccttccacttatgtacgcccgcggcatcttcaactacgatttcggtctcatgccctacagacgccagatgacactcgttgttggcaagcccatcgctgttccatacgttgcccagccaacagaggccgagattgaggtgtaccacaagcagtacatggacgagctcagacgcctctgggacacctacaaggatgattacttcgtggaccataagggcaagggcgtgaagaactccgagatgcgcttcgtggagtaggc

SEQ ID NO: 369 - DNA, 8206 bp, Artificial Sequence
  plasmid pKR1513
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgaaggagcccgtgtccaaggagaacaccgataccaagtccgatcgcaagatcgcccttccagacatcaagaaggtgtcccaggtgatcccaaacgttccagaggttcagtgggctccactcacaggcatcccattcgagcgcagaattcagatggccgtggttctcatgtggatcttcctcctcggtaactgcctcacactcttctgctgctcactcttccttcccttcctttggccactccacatcgcctacatcatctacctctacagagatcagtccgctgagaacggtggcagaagatctgactggttccgccgccttcccatttggaactactacgctggttacttcccagccaagcttgttaaggagcaggacctcgatcccaagaagaactacgtgttcggttcacaccctcatggcatcatctccatctcttccttcgcctctttcgctacagaggctaccggtttctcccagctcttcccaggcatcattccctctctcctcacactcaccaccaacttcaagttccctatcttcagggacatcattctcgccctcggcatcgcttctgtttccagacactcatgcgagaagatcctctcctctggtcccggtagatccatcgtgatcgtgatcggtggtgcttccgagtcccttaacgctagaccaggtatcgccgatctcgtgctcaagaagcgcctcggcttcattagaattgctatcagacatggtgccgacctagttcccgtgttctccttcggcgagaatgagctctacgagcaggtggataactccaccggttcctggctttggaaggcccagaagaagatgcagcaggcccttggtttcacaatgccacttttccatgcccgcggcatcttcaactacaacgtgggtctaatcccataccgccatccaatcgttaccgtggttggcaagccaatcccagtgccaaagatgaagccaggtcagacagagcccacacaggagcagcttctcgagacacaggctctctacatcgaggagctcgagtccatctacaacaagtacaaggacgtgtacgccaaggaccgcaagcaggatctccgcatcgtttcctaggc

SEQ ID NO: 370 - DNA, 8314 bp, Artificial Sequence
  plasmid pKR1416
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatggaccctcaaaccgacccttcctctcctactcagtctcctgttcttcctaaggagggcctttctttgcgccctaccaggtccaagtcctccttggtggagtttgggtcctcttccatctctggccttcgcgataacatctccaccggcatcaacaccttgtccaccgggctcaagacccaggttgagaagaggcgcaaggatcttcctaagggcatcgagatcaagttcgctcccttgaaggttcctcgcaatcgcagacttcagaccggcgctgttgctctttggtccaccttgcttcccatctgtacctccatcttcctctggatgtgttccatccctcgcttgtggcctcttctcatcccctacctcatctgggtgttctacatcgatagggctcctgttttgggcggtcgtcctaagaggtggttgagacgcatgggcatttggaagcacttcgccaactactatcccgtgtcccttgttcaagaggcttcccttcccttggaccgcaagtacatcttcgggtaccaccctcacggtgttatcggcatgggtgctttcgccaacttcgctactgagggtaccaacttctccaagatcttccccggcatcgagcctcacctcctcaccctcgctcccaacttcaagattcctctcttccgcgatctcctcttgctcctcgggatgtgctccgtctctaagcgctcctgctcctctattcttagaaagggccctcccgggactgctatcgtgatcgttgtgggtggtgccactgagtctttgagggctcaccctggcactgctgatcttaccctcaagtcccgcatgggcttcatcaagatcgccatcaacgagggcgtggatctcgttcccgtgttctccttcggcgagaacgacatctacgatcagttggccaacgagcgcggcacccagatctacaagctccagaagcgcttccagtctatcttcgggttcactctccctctctttcacggtcgcggcctcttcaactattccgtgggtctcatgccctatcgtcagcccattgtttccgttgctggcaggcccattcgtgttgttcagtgcaacaaccctacctctgagcagctccaagagactcagggtcgctacattgaggagcttctccgcatctgggacacctacaaggacgtgtacgcccgcaatcgcacaaaggagctcactctcgtggattaggc

SEQ ID NO: 371 - DNA, 8137 bp, Artificial Sequence
  plasmid pKR1423
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgggtgcccaggaggaggtggagtacgatcagtccgagcactccaagatcaagttcgtgccattcgttgtgcccagacacagacgcctccagaccttctccgtgttcctctggaccacagctcttcccatctcactcggcatcttctgcattctctgctccttcccaccactctggcccctcgtgattggctacctcacctgggtgttcctcattgaccaggctcccatgagaggtggccgcccacaggcctggctcaggaagtctagagtgtgggagtggttcgctggttactaccccgtgtcactcatcaagtctgctgaccttcccccagatcagcgctacgtgttcggctaccacccacacggcgtgatcggcatgggtgctattgctaacttcggtacagatgccaccggcttctcccgcctcttcccaggcattacaccacatctcctcaccctcgcttccaacttcaagctcccagtgttccgcgagctccttcttggtctcggtatctcctccgtgtccatgaagtcctgccagaacatcctcagacagggcccaggctcctccatcacaattgtggttggtggcgccgctgagtcactttctgctcacccaggcacagctgacctcacccttaagcgccgcaagggtttcatcaagcttgccattcgcacaggcgcctcacttgtgccagtgttctccttcggcgagaacgacatcttcaaccagctctccaacgagcgcggcacccgcctttacaagctccagaagagattccaagccgtgttcggcttcacacttcccatcttcttcggtcgcggcctcttcaactacaacatgggccttatgccctacagacaccccatcgtttccgtggtgggcagacccatcaaggtgaagcagaaggaccatccctccacagccgaccttgaggaggttcaagagcgctacatcgccgagctcaagcgcatttgggaggattacaaggaggtgtacgccaagtcccgcaccaaggagctcaccatcattgcctaggc

SEQ ID NO: 372 - DNA, 8092 bp, Artificial Sequence
  plasmid pKR1419
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgccacttttcgctccacttcgcatgcccgtgaagagaagaatgcagacaggcgctgtgctctactggatcgccggtatgatctactgcatcggcatcttcgccttcctctgcaccttcaagatcctccgccccctcatcatcatctacgtgctctgggcttacatgcttgatcgcgccccagagagaggcgctagaacagttcagtggtaccgcaactggatcggctggaagcacttcgcccagtacttcccaatgaccctcgtgaaggagggcggcctcgatccatccaagaactacatcttcggctaccacccacacggcatcatttcacttggcgctctttgcgccttcggtacagagggtcttcatttctccaagcgcttcccaggcatcaagccacatctcctcacaatccacgccaacttccagattccactcttccgcgacatgatcatggctcacggttgcgcctccgtttcaagagcctcttgcgagcatatcctcagatccggtgagggctcctctgttgttatcgtggtgggtggtgctcaggagtctctttctacacagcccggcaccctcaatctcacccttaagaagcgcctcggtttctgcaagcttgctctcgtgaacggtgcttctctcgttcccacccttgctttcggcgagaacgagctctacgaggtgtaccacaccaagcccacctcacttatctacaagcttcagcagctcacaaagcgcaccatcggcttcacaatgcccgtgttcaacggtcgcggcatcttcaactacgagttcggccttctcccacgccgcaagcccgtttacatcgtcatcggcaatcccatccacgttgacaaggtggagaatcccaccatcgagcagatgcagaagctccagtccatctacatcgacgaggtgctcaacatctgggagcgctacaaggacaagtacgccgccggcagaacccaggagctttgcatcattgagtaggc

SEQ ID NO: 373 - DNA, 8602 bp, Artificial Sequence
  plasmid pKR1522
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgatggccgaggttctctccgtttccgcctccgcttctccctcttcctccatctcctccaccacctccaccgagcccacaacagacattggcgagggttctcttggtctttccccaggtccagccggtctcagacttagattccctaggaatggaggctcccttacccaccattcctccgactacggtaaggacctttctcccgctccatctcttctcacactccactccgctcccgactccccagatgccaattctcccgcttccgagcgctccgacctttactccgactacgacctccccgatccagatactggtccagccgttccagttgctcgtcgcaagagatctgcctccgatggtccaacaccaggctctctcatgcttaccgcactcgacgagaagcccgtgaagacaaagtccaagatccagcgcctcaagtccaagtccccactccttgagtcccttaagctcccacccctctccgagatttccattcccagacccgagcagatcaagttcgctcccctccacatccctccacatagacgccttcagaccgctgccgttgctacctgggctcttcttatgccactctgcttcatcgccttcctcttcgccctctccttccccagactctggcctgttctcattccctacatgatctggggtgtgttcttcgaccaggcaccagagcatggtggtagacccaagaagtgggctcgtcgcttcttcatgtggaagtactacgcccagtactacccatgctccatcgtgaaggaggccgatctcccagcctccaataagtatgtgttcggctaccatccacacggcatcatcggtatgggtgccgttgctgctttcgcttctgaggccaccggtttctccgactacttcccaggtattcgcccacatcttctcaccctcgacaccaacttcaacatccccttcttccgcgagatcctcatgtggctcggtatctgctccgtgtccaaggcctcctgcagaaacattctcgccaagggtcctggctacgccattaccatcgttgttggtggtgctgctgagtctcttgccgctcacccaggtacccaggatctcacccttaagaagcgcttcggcttcgttaaggtggccatcagagagggagctcagcttgttccagtgttctccttcggcgagaacgacatctacgaccagctcgccaatgagaagggctccacagtgtacaagctccagaagaccttccagaagatcttcggtttcacactcccactcttccacggtcgtggcctcttcaactacaactacggcctcatgcccttccgccacccaattgtgacagttgtgggcagacccgtgaccgttaagcagaacctcaacccacaggacgaggaggtacaggaggttcaccgcagatacatcgaggagctcgttagagtgtgggataagtacaaggacatctacgccaagaatcgctctcgcgagctctccatcgttgagtaggc

SEQ ID NO: 374 - DNA, 8761 bp, Artificial Sequence
  plasmid pKR1514
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgctcgaccatatctcctccggtacagccacagcctccaccaccaccgtgatgtctaccgctgcccagtccgataccgacaacgaggatatctctaccgtggaccttgtggactcccgcgccgacacccacacctcttccaacgtgatgctccagcagcagaagtccagaagacgcctcatcggtaaggatgccgagcccagaacccagcacccatccggcggtaagtctgagaaggaggagcttaccaagccagacgactccaagggtcccatcaagctctcccacatctaccctatccacgctgtgtcacgcggttctatcctctctcgcgagtctaccacaccaacaccctccttcgtgggcttcagaaacctcgccatgatcgtgctcgccgtttccaacctccgccttgttatcgagaactactccaagtacggcgtgctcatccgcttcgctcgcctcggtatctctcagaaggacatcctctactgcatcttcctcaccgccaccatcccactccacctcttcatcgccatcgttatcgagcgcctcgttgccatcccaaccgtgaactacgttgcctcactctccgagtccgaggacaagaagcgctccaaccctaagatgggccgcaagggcggttccatctctatccttcgcccaaagcctaagtacatgtggcgcctcatcgtgctcctccactccatcaacgctatggcctgcctctgggttaccaccgttgtggtgtacaactccatctaccaccctctcatcggcaccgcctgcgagttccacgccgttatcgtttgccttaaggttgcctcattcgcccttaccaaccgcgacctccgcgagtccatgcttaactctcagccagtgcccgccatctacaacctcgctccctatcccaagaacctcacccttaagaacctctcctacttctggtgggctcccacactcgtttaccagcccgtttacccacgctctccctccttccgcccactcttcttcgttaagcgcatcctcgagatggttggcctctccttcctcatctggttcctttcagcccagtacgctgtgccaacactcgagaactccctcgttcacttccactccctccagttcatgggcatcatggagcgcctcatgaagctcgcctctatctctatggccatctggctcgccggtttcttctgcatcttccagtctggcctcaacgccctcgctgaggttatgcgcttcggtgacagagccttctacgacgactggtggaactccaagtccgtgggtgagtactggagactctggaacaagcccgtgaccaactacttccgccgccacatctacgtgccacttgtgagacgcggttggaactccgccaccgcctccgttatggtgttcttcgtttctgccgtgctccacgagctcgttgttggcgtgcccacacacaacgttatcggcgttgccttctcctccatgatcctccagatccctctcattcaggtgaccgctccactcgagaagatgcacggtcccacctccggtatcatcggcaattgcatcttctggttctccttcttcatcggccagccactcggtgtgctcctctactacttcgcctggaacgtgtccatgtccaaggtgaagatggtggagtcctaggc

SEQ ID NO: 375 - DNA, 8674 bp, Artificial Sequence
  plasmid pKR1511
ggccgcaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacaagcttggcgcgccgttctatagtgtcacctaaatcgtatgtgtatgatacataaggttatgtattaattgtagccgcgttctaacgacaatatgtccatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcaggttgatcgattcgacatcgatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatctgcttcgacgcactccttctttaggtacctcactattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtttaataagaagagaaaagagttcttttgttatggctgaagtaatagagaaatgagctcgagcgtgtcctctccaaatgaaatgaacttccttatatagaggaagggtcttgcgaaggatagtgggattgtgcgtcatcccttacgtcagtggagatgtcacatcaatccacttgctttgaagacgtggttggaacgtcttctttttccacgatgctcctcgtgggtgggggtccatctttgggaccactgtcggcagaggcatcttgaatgatagcctttcctttatcgcaatgatggcatttgtaggagccaccttccttttctactgtcctttcgatgaagtgacagatagctgggcaatggaatccgaggaggtttcccgaaattatcctttgttgaaaagtctcaatagccctttggtcttctgagactgtatctttgacatttttggagtagaccagagtgtcgtgctccaccatgttgacgaagattttcttcttgtcattgagtcgtaaaagactctgtatgaactgttcgccagtcttcacggcgagttctgttagatcctcgatttgaatcttagactccatgcatggccttagattcagtaggaactacctttttagagactccaatctctattacttgccttggtttatgaagcaagccttgaatcgtccatactggaatagtacttctgatcttgagaaatatgtctttctctgtgttcttgatgcaattagtcctgaatcttttgactgcatctttaaccttcttgggaaggtatttgatctcctggagattgttactcgggtagatcgtcttgatgagacctgctgcgtaggcctctctaaccatctgtgggtcagcattctttctgaaattgaagaggctaaccttctcattatcagtggtgaacatagtgtcgtcaccttcaccttcgaacttccttcctagatcgtaaagatagaggaaatcgtccattgtaatctccggggcaaaggagatctcttttggggctggatcactgctgggccttttggttcctagcgtgagccagtgggctttttgctttggtgggcttgttagggccttagcaaagctcttgggcttgagttgagcttctcctttggggatgaagttcaacctgtctgtttgctgacttgttgtgtacgcgtcagctgctgctcttgcctctgtaatagtggcaaatttcttgtgtgcaactccgggaacgccgtttgttgccgcctttgtacaaccccagtcatcgtatataccggcatgtggaccgttatacacaacgtagtagttgatatgagggtgttgaatacccgattctgctctgagaggagcaactgtgctgttaagctcagatttttgtgggattggaattggatcgatctcgatcccgcgaaattaatacgactcactatagggagaccacaacggtttccctctagaaataattttgtttaactttaagaaggagatatacccatggaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagtgaggtacagcttggatcgatccggctgctaacaaagcccgaaaggaagctgagttggctgctgccaccgctgagcaataactagcataaccccttggggcctctaaacgggtcttgaggggttttttgctgaaaggaggaactatatccggatgatcgggcgcgccgtcgacggatccgtacgagatccggccggccagatcctgcaggagatccaagcttttgatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactgcggccgcaccatgaccgagtccaccaccacaacctgcaccaaggaggagggcattgccaactctgccgctcttcccgacatcccaccaaagatggaggacctcaagtcctccagaaagaccggctcctcttacaagcacaccttccctgtgcacaccaagaccattccctcaccactttccaaggaggctccaccagagtcttaccgcggtttcgtgaacctcggcatgcttctcctcttcggcaacaacatccgcctcatcatcgagaactacctcaagtacggtttcctcctctccattcccggttcctccgtgtccaagcaggactggattctcgccgcccttacccatgccatccttcccgtgaacctcatcctcgcctacaagctcgagtcatgggctaaggagcgcgccgtgggttacagaaagcgcagatccgatgagccaatcgctcaggagtccaccaaggctgttgctgccggtgacaacgacgccatcaagaccaccaagccagctaaggctcaggaccttacaccagaggcccttgccagaaaggagcagtctaccgttggctggctccacgtgttcaacctcttcaccatcgtggcctggccctccttcatgtcctacttcatgatctaccatcccttcgtggccatgtcctgccttatgaacggcctcatcctcttcctcaagatgacctcattcgccctcgtgaaccaggagcttcgcgccgcttacatcttcggtacaccagtggacaccttccagcatatggccaaggtgcacgacatctccggcaaggacctcaccaagaaggagatcttccagtacgacatccagtaccctgacaacatcaccctcaagaacatcggctacttctggcttgctcccaccctctgctaccagccatcctacccacgcacaaccgtgttcagaaagtccttcttcctcaagcgcgtggccgagatcgtgacctgcctcggcatgatgtacttccttgtggagcagtacgccacaccaacactccagaattcagtgagagccttcgacgagctcgccttcggtaccattctcgagcgcgttctcaagctctccaccacctccgtgatcatctggctcctcatgttctacaccttcttccactccttcttcaacgcccttgctgaggctctctacttcggtgatcgccgcttctaccttgcttggtggaacgccaccggtgttggtatgtactggaagacctggaactcacccgtgtacaccttcttcaagcgccacgtgtacctcccactcatcacctccggcacctctccaatggttgcctctatcgtgatcttcttcatctccgccgtgctccacgagatcctcatcggcttcccaacacacatgatctacggctacgccttcgccggcatgttcctccagatccctctcatcatcctcaccagaccactcgagaagtggagaggtaccggttccggcctcggtaacatgatcttctgggtgtccttcaccatcctcggtcagccagcctgcgccctcctctactactaccactggaccaagcgccacatggacgtgtaggc

What is claimed is:

1. An isolated polynucleotide comprising
a nucleotide sequence encoding a polypeptide having diacylglycerol acyltransferase activity wherein the polypeptide has at least 95% amino acid identity, based on the Clustal V method of alignment, when compared to an amino acid sequence as set forth in SEQ ID NO:308.

2. The isolated polynucleotide of claim 1 wherein the nucleotide sequence comprises SEQ ID NO:307.

3. A recombinant DNA construct comprising the isolated polynucleotide of claim 1 operably linked to at least one regulatory sequence.

4. The recombinant DNA construct of claim 3, wherein the isolated polynucleotide encodes a polypeptide having the amino acid sequence set forth in SEQ ID NO:308.

5. The recombinant DNA construct of claim 3, wherein the isolated polynucleotide comprises SEQ ID NO:307.

6. The isolated polynucleotide of claim 1, wherein said nucleotide sequence encodes a polypeptide having the amino acid sequence set forth in SEQ ID NO:308.

7. The isolated polynucleotide of claim 1, wherein the polynucleotide comprises a nucleotide sequence having at least 95% sequence identity, based on the BLASTN method of alignment, when compared to a nucleotide sequence as set forth in SEQ ID NO:307.

8. An isolated polynucleotide comprising a complement of the nucleotide sequence of claim 1, wherein the complement and the nucleotide sequence consist of the same number of nucleotides and are 100% complementary.

9. The isolated polynucleotide of claim 1, wherein said nucleotide sequence encoding said polypeptide has been codon-optimized for expression in a plant.

10. A cell comprising in its genome a recombinant DNA construct, wherein said recombinant DNA construct comprises a polynucleotide operably linked to at least one regulatory sequence, wherein said polynucleotide comprises a nucleotide sequence encoding a polypeptide having diacylglycerol acyltransferase activity, wherein the polypeptide has at least 95% amino acid identity, based on the Clustal V method of alignment, when compared to an amino acid sequence as set forth in SEQ ID NO:308.

11. The cell of claim 10 wherein said cell is an oilseed plant cell.

12. The cell of claim 10 wherein said cell is a fungal cell or oleaginous microbial organism.

13. The fungal cell of claim 12 wherein said fungal cell is selected from the group consisting of *Yarrowia, Candida, Rhodotorula, Rhodosporidium, Cryptococcus, Trichosporon* and *Lipomyces*.

14. The cell of claim 10, wherein said nucleotide sequence encodes a polypeptide having the amino acid sequence set forth in SEQ ID NO:308.

15. A transgenic oilseed comprising in its genome a recombinant DNA construct, wherein said recombinant DNA construct comprises a polynucleotide operably linked to at least one regulatory sequence, wherein said polynucleotide comprises a nucleotide sequence encoding a polypeptide having diacylglycerol acyltransferase activity, wherein the polypeptide has at least 95% amino acid identity, based on the Clustal V method of alignment, when compared to an amino acid sequence as set forth in SEQ ID NO:308.

16. The transgenic oilseed of claim 15 wherein said oilseed is selected from the group consisting of soybean, corn, canola, sunflower, flax, cotton, and safflower.

17. A product or a by-product obtained from the transgenic oilseed of claim 15, wherein said product or said by-product comprises said recombinant construct.

18. A progeny plant obtained from the transgenic oilseed of claim 15.

19. The transgenic oilseed of claim 15, wherein said nucleotide sequence encodes a polypeptide having the amino acid sequence set forth in SEQ ID NO:308.

20. A method for increasing the total fatty acid content of an oilseed comprising:

(a) transforming at least one oilseed cell with a recombinant DNA construct, wherein said recombinant DNA construct comprises a polynucleotide operably linked to at least one regulatory sequence, wherein said polynucleotide comprises a nucleotide sequence encoding a polypeptide having diacylglycerol acyltransferase activity, wherein the polypeptide has at least 95% amino acid identity, based on the Clustal V method of alignment, when compared to an amino acid sequence as set forth in SEQ ID NO:308; and (b) selecting the transformed oilseed cell(s) of step (a) having an increased total fatty acid content when compared to the total fatty acid content of a non-transgenic, null segregant oilseed.

21. The method of claim 20 wherein the oilseed is selected from the group consisting of soybean, corn, canola, sunflower, flax, cotton, and safflower.

22. The method of claim 20, wherein said nucleotide sequence encodes a polypeptide having the amino acid sequence set forth in SEQ ID NO:308.

23. An isolated polynucleotide comprising a nucleotide sequence encoding a polypeptide having diacylglycerol acyltransferase activity, wherein the nucleotide sequence hybridizes under high stringency conditions to the complement of a nucleotide sequence as set forth in SEQ ID NO:307, wherein said high stringency conditions include hybridization in 50% formamide, 1M NaCl, 1% SDS at 37° C. and a wash in 0.1X SSC at 60 to 65° C.

* * * * *